(12) United States Patent
Blein et al.

(10) Patent No.: US 9,493,563 B2
(45) Date of Patent: Nov. 15, 2016

(54) PRODUCTION OF T CELL RETARGETING HETERO-DIMERIC IMMUNOGLOBULINS

(71) Applicant: GLENMARK PHARMACEUTICALS S.A., La Chaux-de-Fonds (CH)

(72) Inventors: Stanislas Blein, La Chaux-de-Fonds (CH); Romain Ollier, La Chaux-de-Fonds (CH); Darko Skegro, La Chaux-de-Fonds (CH); Samuel Hou, La Chaux-de-Fonds (CH)

(73) Assignee: GLENMARK PHARMACEUTICALS S.A., La Chaux-de-Fonds (CH)

( * ) Notice: Subject to any disclaimer, the term of this patent is extended or adjusted under 35 U.S.C. 154(b) by 0 days.

(21) Appl. No.: 14/532,923

(22) Filed: Nov. 4, 2014

(65) Prior Publication Data

US 2015/0133640 A1 May 14, 2015

(30) Foreign Application Priority Data

Nov. 4, 2013 (EP) .................................... 13191386

(51) Int. Cl.
*C07K 16/28* (2006.01)
*C07K 16/46* (2006.01)
*C07K 16/32* (2006.01)
*C07K 16/42* (2006.01)

(52) U.S. Cl.
CPC ....... *C07K 16/2809* (2013.01); *C07K 16/2863* (2013.01); *C07K 16/2878* (2013.01); *C07K 16/2887* (2013.01); *C07K 16/2896* (2013.01); *C07K 16/32* (2013.01); *C07K 16/4291* (2013.01); *C07K 16/468* (2013.01); *C07K 2317/24* (2013.01); *C07K 2317/31* (2013.01); *C07K 2317/33* (2013.01); *C07K 2317/52* (2013.01); *C07K 2317/526* (2013.01); *C07K 2317/55* (2013.01); *C07K 2317/565* (2013.01); *C07K 2317/567* (2013.01); *C07K 2317/622* (2013.01); *C07K 2317/71* (2013.01); *C07K 2317/92* (2013.01); *C07K 2317/94* (2013.01)

(58) Field of Classification Search
CPC .......... C07K 16/2809; C07K 16/2878; C07K 16/2863; C07K 16/2887; C07K 16/468; C07K 2317/24; C07K 2317/31
USPC ..................... 435/69.6; 530/387.3
See application file for complete search history.

(56) References Cited

U.S. PATENT DOCUMENTS

| | | | |
|---|---|---|---|
| 5,821,337 A | 10/1998 | Carter et al. | |
| 6,329,509 B1 | 12/2001 | Jardieu et al. | |
| 6,761,889 B2 | 7/2004 | Lowman et al. | |
| 2008/0003218 A1 | 1/2008 | Lowman et al. | |
| 2015/0239991 A1* | 8/2015 | Blein | B01D 15/3809 |
| | | | 530/389.5 |

FOREIGN PATENT DOCUMENTS

| | | |
|---|---|---|
| EP | 2 522 724 A1 | 11/2012 |
| WO | WO 94/11026 A2 | 5/1994 |
| WO | WO 95/33844 A1 | 12/1995 |
| WO | WO 96/27011 A1 | 9/1996 |
| WO | WO 96/40210 A1 | 12/1996 |
| WO | WO 2005/103083 A2 | 11/2005 |
| WO | WO 2006/099875 A1 | 9/2006 |
| WO | WO 2008/047242 A2 | 4/2008 |
| WO | WO 2008/119353 A1 | 10/2008 |
| WO | WO 2008/119565 A2 | 10/2008 |
| WO | WO 2010/033736 A1 | 3/2010 |
| WO | WO 2010/075548 A2 | 7/2010 |
| WO | WO 2010/095031 A2 | 8/2010 |
| WO | WO 2010/108127 A1 | 9/2010 |
| WO | WO 2010/151792 A1 | 12/2010 |
| WO | WO 2011/131746 A2 | 10/2011 |
| WO | WO 2011/154453 A1 | 12/2011 |
| WO | WO 2012/092612 A1 | 7/2012 |
| WO | WO 2012/131555 A2 | 10/2012 |
| WO | WO 2012/138997 A1 | 10/2012 |
| WO | WO 2012/143524 A2 | 10/2012 |
| WO | WO 2013/008171 A1 | 1/2013 |
| WO | WO 2013/060867 A2 | 5/2013 |
| WO | WO 2014/049003 A1 | 4/2014 |
| WO | WO 2015/063339 A1 | 5/2015 |

OTHER PUBLICATIONS

Almagro, J.C. and Fransson, J., "Humanization of antibodies," *Front Biosci* 13:1619-1633, Frontiers in Bioscience Publications, United States (2008).
Anderson, K.C., et al., "Expression of human B cell-associated antigens on leukemias and lymphomas: a model of human B cell differentiation," *Blood* 63(6):1424-1433, Grune & Stratton, Inc. United States (1984).
Bird, R.E., et al., "Single-Chain Antigen-Binding Proteins," *Science* 242(4877): 423-426, American Association for the Advancement of Science, United States (1988).
Bühler, P., et al., "A bispecific diabody directed against prostate-specific membrane antigen and CD3 induces T-cell mediated lysis of prostate cancer cells," *Cancer Immunol Immunother* 57(1):43-52, Springer Verlag, Germany (2008).
Edelman, G.M., et al., "The Covalent Structure of an Entire γG Immunoglobulin Molecule," *PNAS* 63:78-85, National Academy of Sciences, United States (1969).

(Continued)

*Primary Examiner* — Lynn Bristol

(74) *Attorney, Agent, or Firm* — Sterne, Kessler, Goldstein & Fox P.L.L.C.

(57) ABSTRACT

The present invention describes novel hetero-dimeric immunoglobulins or fragments thereof which bind to CD3 and a disease associated antigen. These hetero-dimeric immunoglobulins have been engineered to promote hetero-dimer formation during expression and can be purified to a high degree using a Protein A differential purification technique.

3 Claims, 66 Drawing Sheets

(56) References Cited

OTHER PUBLICATIONS

Ewert, S., et al., "Biophysical properties of human antibody variable domains," *J Mol Biol* 325(3):531-553, Elsevier Science Ltd., England (2003).
Frankel, S.R. and Baeuerle, P.A., "Targeting T cells to tumor cells using bispecific antibodies," *Curr Opin Chem Biol* 17(3):385-392, Elsevier Ltd., England (Apr. 2013).
Friedrich, M., et al., "Regression of human prostate cancer xenografts in mice by AMG 212/BAY2010112, a novel PSMA/CD3-Bispecific BiTE antibody cross-reactive with non-human primate antigens," *Mol Cancer Ther* 11(12):2664-2673, American Association for Cancer Research, United States (Oct. 2012).
Garber, E. and Demarest, S.J., "A broad range of Fab stabilities within a host of therapeutic IgGs," *Biochem. Biophys. Res. Commun.* 355(3):751-757, Elsevier Inc., United States (2007).
Graille, M., et al., "Crystal structure of a *Staphylococcus aureus* protein A domain complexed with the Fab fragment of a human IgM antibody: structural basis for recognition of B-cell receptors and superantigen activity," *Proc Natl Acad Sci USA* 97(10):5399-5404, National Academy of Sciences, United States (2000).
Grossbard, M.L., et al., "Anti-B4-blocked ricin: a phase II trial of 7 day continuous infusion in patients with multiple myeloma," *Br J Haematol* 102(2):509-515, Blackwell Science Ltd., England (1998).
Hober. S., et al., "Protien A Chromatography for antibody purification," *Journal of Chromatography B* 848(1):40-47, Elsevier B.V., Netherlands (2007).
Hollinger, P., et al., "Diabodies': Small bivalent and bispecific antibody fragments," *Proc Natl Acad Sci* 90:6444-6448, National Academy of Sciences, United States (1993).
Hoshino, S.I. et al., "Mapping of the catalytic and epitopic sites of human CD38/$NAD^+$ gylcohydrolase to a functional domain in the carboxyl terminus," *J Immunol* 158(2):741-747, American Association of Immunologists, United States (1997).
Huston, J.S., et al., "Protein engineering of antibody binding sites: Recovery of specific activity in an anti-digoxin single-chain Fv analogue produced in *Escherichia coli*," *Proc Natl Acad Sci* 85:5879-5883, National Academy of Science, United States (1988).
Jansson, B., et al., "All individual domains of staphylococcal protien A show Fab binding," *FEMS Immunol Med Microbiol* 20(1):69-78, Elsevier Science B.V., Netherlands (1998).
Jendeberg, L., et al., "Engineering of $Fc_1$ and $Fc_3$ from human immunoglobulin G to analyse subclass specificity for Staphylocoal protein A," *J Immunol Methods* 201(1):25-34, Elsevier Science B.V., Netherlands (1997).
Jung, S. and Plückthun, A., "Improving in vivo folding and stability of a single-chain Fv antibody fragment by loop grafting," *Protien Engineering* 10(8):959-966, Oxford University Press, England (1997).
Kaas, Q., et al., "IG, TR and IgSF, MHC and MhcSF: what do we learn from the IMGT Colliers de Perles?," *Briefings in Functional Genomics & Proteomics* 6(4):253-264, Oxford University Press, England (2008).
Kabat, E.A., "The structural basis of antibody complementarity," *Adv Protein Chem* 32:1-75, Academic Press, United States (1978).
Klein, C., et al., "Progress in overcoming the chain association issue in bispecfic heterodimeric IgG antibodies," *mAbs* 4(6):653-663, Landes Bioscience, United States (Nov./Dec. 2012).
Labrijn, A.F., et al., "Efficient generation of stable bispecific IgG1 by controlled Fab-arm exchange," *Proc Natl Acad Sci USA* 110(13):5145-5150, National Academy of Sciences, United States (Mar. 2013).
Lefranc, M.P., et al., "IMGT, the international ImMunoGeneTics database," *Nucleic Acids Res* 27(1):209-212, Oxford University Press, England (1999).
Lefranc, M.P., "IMGT, the international ImMunoGeneTics database," *Nucleic Acids Res* 29(1):207-209, Oxford University Press, England (2001).
Lefranc, M.P., "IMGT, the international ImMunoGeneTics database," *Nucleic Acids Res* 31(1):307-310, Oxford University Press, England (2003).
Lefranc, M.P., et al., "IMGT unique numbering for immunoglobulin and T cell receptor constant domains and Ig superfamily C-like domains," *Dev Comp Immunol* 29(3):185-203, Elsevier Science, United States (2005).
Lindhofer, H., et al., "Preferential speccies-restricted heavy/light chain pairing in rat/mouse quadromas: Implications for a single-step purification of bispecific antibodies," *J Immunol* 155(1):219-225, American Association of Immunologists, United States (1995).
Liu, H.F., et al., "Recovery and purification process development for monoclonal antibody production," *mAbs* 2(5):480-499, Landes Bioscience, United States (2010).
Loken, M.R., et al., "Flow cytometric analysis of human bone marrow. II. Normal B lymphocyte developmentt," *Blood* 70(5):1316-1324, Grune & Stratton, Inc., United States (1987).
Marks, J.D., et al., "By-passing immunization: Human antibodies fromm V-gene libraries displayed on phage," *J Mol Biol* 222(3):581-597, Academic Press, England (1991).
May, C., et al., "Advances in biospecfic biothrapeutics for the treatment of cancer," *Biochem Pharmacol* 84(9):1105-1112, Elsevier Inc., England (Nov. 2012).
Moore, P.A., et al., "Application of dual affinity retargeting molecules to achieve optimal redirected T-cell killing of B-cell lymphoma," *Blood* 117(17):4542-4551, American Society of Hematology, United States (2011).
Nadler, L.M., et al., "B4, a Human B Lymphocyte-Associated Antigen Expressed on Normal Mitogen-Activated, and Malignant B Lymphocytes," *J Immunol* 131(1):244-250, The American Association of Immunologists, United States (1983).
Nagy, P., et al., "Decreased accessibility and lack of activation of ErbB2 in JIMT-1, a herceptin-resistant, MUC4-expressing breast cancer cell line," *Cancer Res* 65(2):473-482, American Association for Cancer Research, United States (2005).
Paterson, D.J., et al., "Antigens of Activated Rat T Lymphocytes Including a Molecule of 50,000 $M_\gamma$Detected Only on CD4 Positive T Blasts," *Molecular Immunology* 24(12):1281-1290, Pergamon Journals Ltd., England (1987).
Pessano. S., et al., The T3/T cell receptor complex: antigenic distinction between the two 20-kd T3 (T3-$\delta$ and T3-$\epsilon$) subnits, *The EMBO Journal* 4(2):337-344, IRL Press Limited, England (1985).
Presta, L.G., et al., "Humanization of an antibody directed against IgE," *J Immunol* 151(5):2623-2632, American Association of Immunologists, United States (1993).
Roben, P.W., et al., "$V_H3$ family anitibodies bind domain D Staphylococcal protien A," *J Immunol* 154(12):6437-6445, American Association of Immunologists, United States (1995).
Ruiz, M., et al., "IMGT, the international ImMunoGeneTics database,"*Nucleic Acids Research* 28(1):219-221, Oxford University Press, England (2000).
Scheuermann, R.H. and Racila, E., "CD19 antigen in leukemia and lymphoma diagnosis and immunotherapy," *Leuk Lymphoma* 18:385-397, Harwood Academic Publishers GmbH. Singapore (1995).
Schlereth, B., et al., "Eradication of tumors from a human colon cancer cell line and from ovarian cancer metastases in immunodeficient mice by a single-chain Ep-CAM-/CD3-bispecific antibody consturct," *Cancer Res* 65(7):2882-2889, American Association for Cancer Research, United States (2005).
Schofield, D.J., et al., "Application of phage display to high throughput antibody generation and characterization," *Genome Biol* 8:R254.1-R254.18, BioMed Central Ltd., England (2007).
Tashiro, M,, and Montelione, G.T., "Structures of bacterial immunoglobulin-binding domains and their complexes with immunoglobulins," *Curr Opin Struct Biol* 5(4):471-481, Current Biology Ltd., England (1995).
Tomlinson, I. and Holliger, P., "Methods for Generating Multivalent and Bispecific Antibody Fragments," *Methods in Enzymology* 326: 461-479, Academic Press, United States (2000).

(56) References Cited

OTHER PUBLICATIONS

Treon, S.P., et al., "Expression of serotherapy target antigens in Waldenstrom's macroglobulinemia: therapeutic applications and considerations," *Semin Oncol* 30(2):248-252, Elsevier Inc., United States (2003).

Uckun, F.M., et al., "Detailed studies on expression and function of CD19 surface determinant by using B43 monoclonal antibody and the clinical potential of anti-CD19 immunotoxins," *Blood* 71(1):13-29, Grune & Stratton, Inc., United States (1988).

Van Der Merwe, P.A. and Dushek, O., "Mechanisms for T cell receptor triggering," *Nat Rev Immunol* 11(1):47-55, Nature Publishing Group, England (2011).

Viti, F., et al., "Design and use of phage display libraries for the selection of antibodies and enzymes,"*Methods Enzymol* 326:480-505, Academic Press, United States (2000).

Vogel, M., et al., "A highly conserved interspecies $V_H$ in the human genome,"*J Mol Biol* 341(2):477-489, Elsevier Ltd., England (2004).

Ward, E.S., et al., "Binding Activities of a Repertoire of single Immunoglobulin Variable Domains Secreted From *Escherichia coli*," *Nature* 341(6246):544-546, Nature Publishing Group, England (1989).

Wucherpfennig, K.W., et al., "Structural biology of the T-cell receptor: insights into receptor assembly, ligand recongnition, and initiation of signaling," *Cold Spring Harb Perspect Biol* 2:1-14, Cold Spring Harbor Laboratory Press, United States (2010).

Blumenthal, G.M., et al., "First FDA Approval of Dual Anti-HER2 Regimen: Pertuzumab in Combination with Trastuzumab and Docetaxel for HER2-Positive Metastatic Breast Cancer,"*Clin Cancer Res*. 19(18):4911-4916, The American Association for Cancer Research, United States (Jun. 2013).

Jackman, J., et al., "Development of a Two-part Strategy to Identify a Therapeutic Human Bispecific Antibody that Inhibits IgE Receptor Signaling," *J. Biol Chem*. 285(27):20850-20859, The American society for Biochemistry and Molecular Biology, Inc., United States (2010).

Kufer, P., et al., "A Revival of Bispecific Antibodies," *Trends in Biotechnology* 22(5):238-244, Elsevier Ltd., England (2004).

Merchant, A.M., et al., "An Efficent Route to Human Bispecific IgG," *Nature Biotechnology* 16(7)677-681, Nature America Publishing, United States (1998).

Tsang, R.Y. and Finn, R.S, "Beyond Trastuzumab: Novel Therapeutic Strategies in HER2-positive Metastatic Breast Cancer," *Br J Cancer* 106:6-13, Nature Publishing Group, England (Jan. 2012).

UniProt "T-cell surface glycoprotein CD3 epsilon chain," identifying No. P07766-CD3E_HUMAN, accessed at http://www.uniprot.org/uniprot/P07766, accessed on Jun. 15, 2015, 13 pages.

UniProt "T-cell surface glycoprotein CD3 gamma chain," identifying No. P09693-CD3G_HUMAN, accessed at http://www.uniprot.org/uniprot/P09693, accessed on Jun. 15, 2015, 13 pages.

UniProt "T-cell surface glycoprotein CD3 epsilon chain," identifying No. Q95L15-CD3E_MACFA, accessed at http://www.uniprot.org/uniprot/Q95LI5, accessed on Jun. 15, 2015, 7 pages.

Potter, K.N., et al., "Staphylococcal Protein A Binding to $V_{H3}$ Encoded Immunoglobulins," *International Reviews of Immunology* 14(4):291-308, Harwood Academic Publishers, Great Britain (1997).

International Search Report and Written Opinion in International Application No. PCT/EP2014/073738, European Patent Office, Munich, mailed Feb. 20, 2015, 16 pages.

Jendenberg, L., et al., "Engineering of $Fc_1$ and $Fc_3$ from human immunoglobulin G to analyse subclass specificity for staphylococcal protein $A^1$," Journal of Immunological Methods 201(1):25-34, Elsevier Science Publishers B.V., Netherlands (1997).

Roopenian, D.C., et al., "FcRn: the neonatal Fc receptor comes of age," The Journal of Immunology 7(9):715-725, Nature Publishing Group, England (2007).

\* cited by examiner

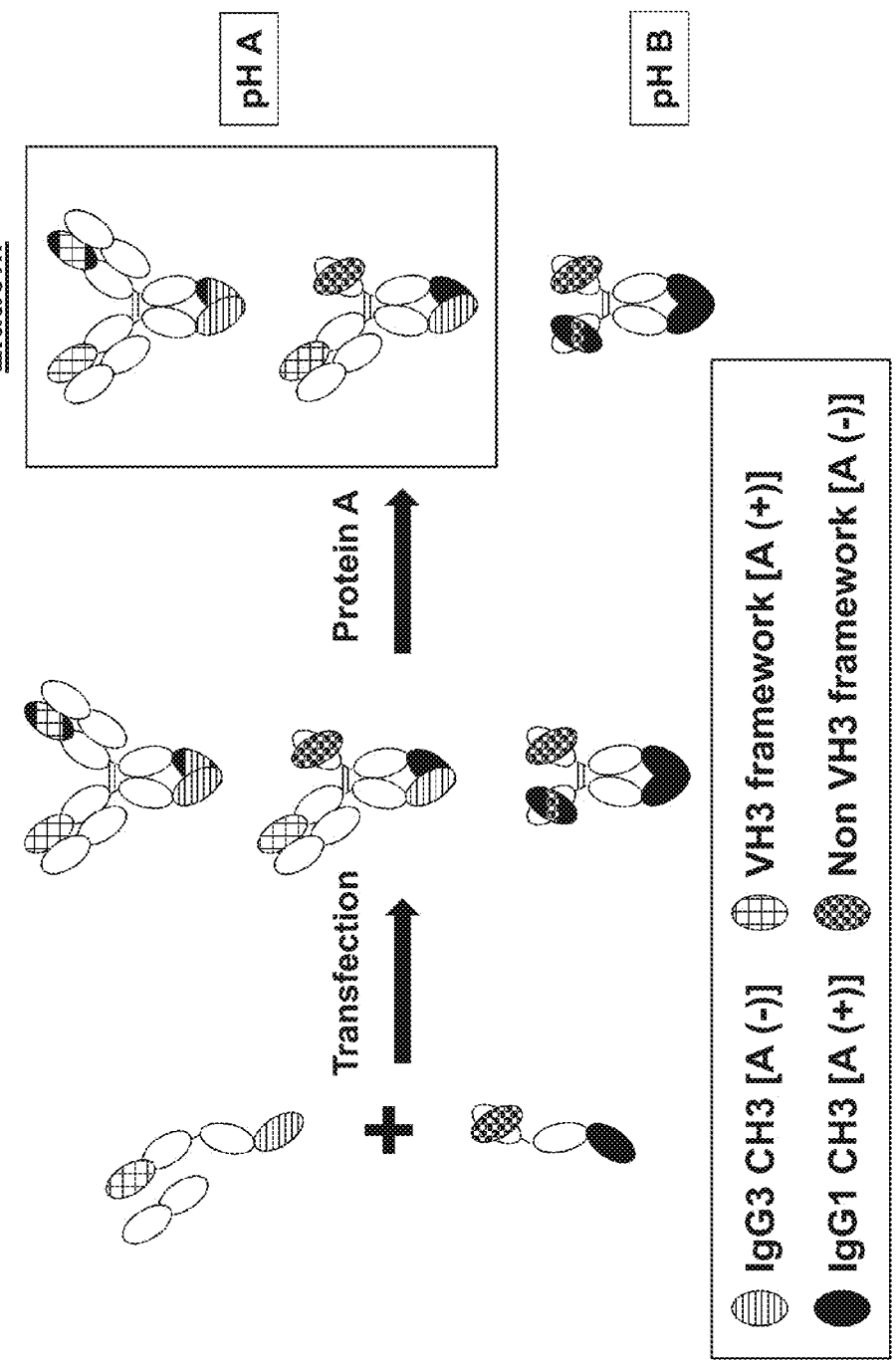

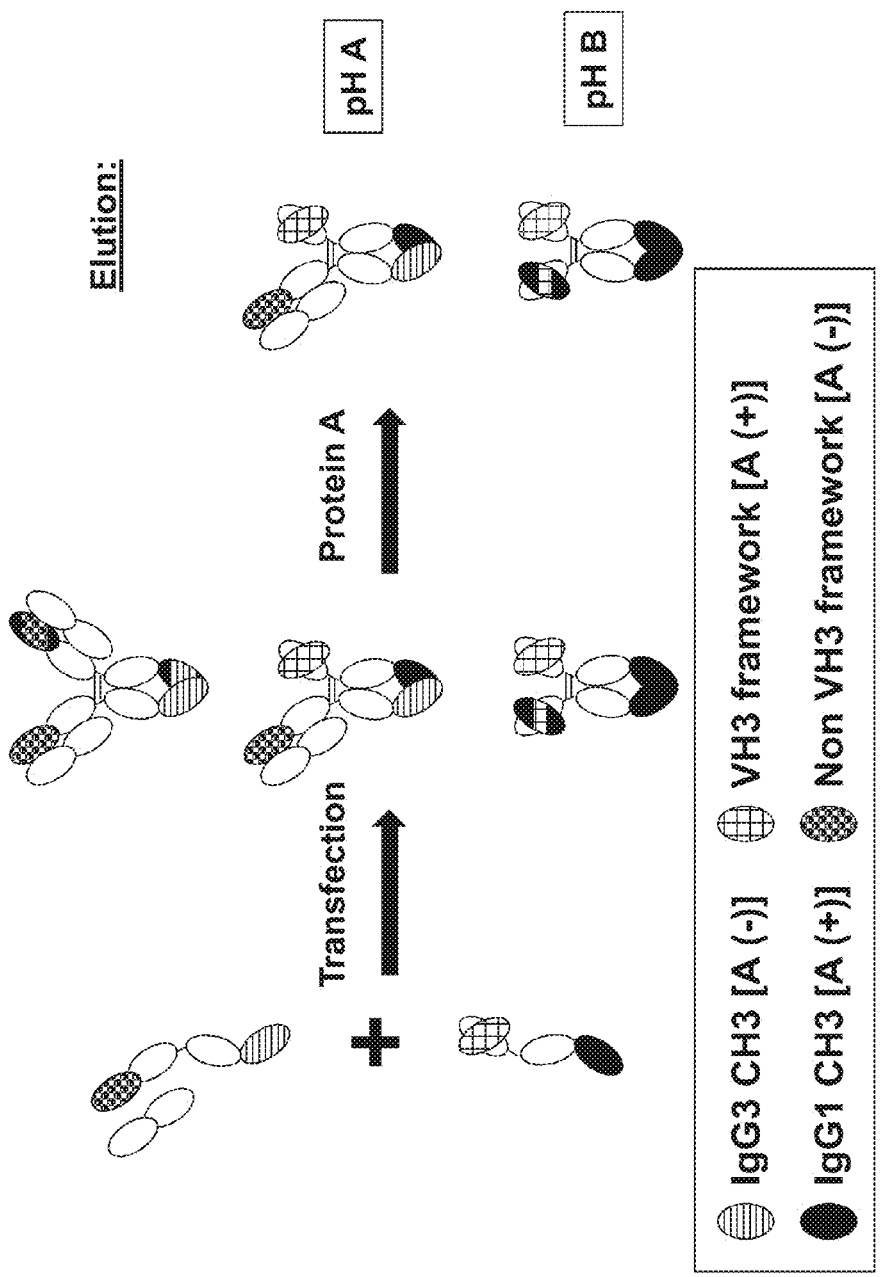

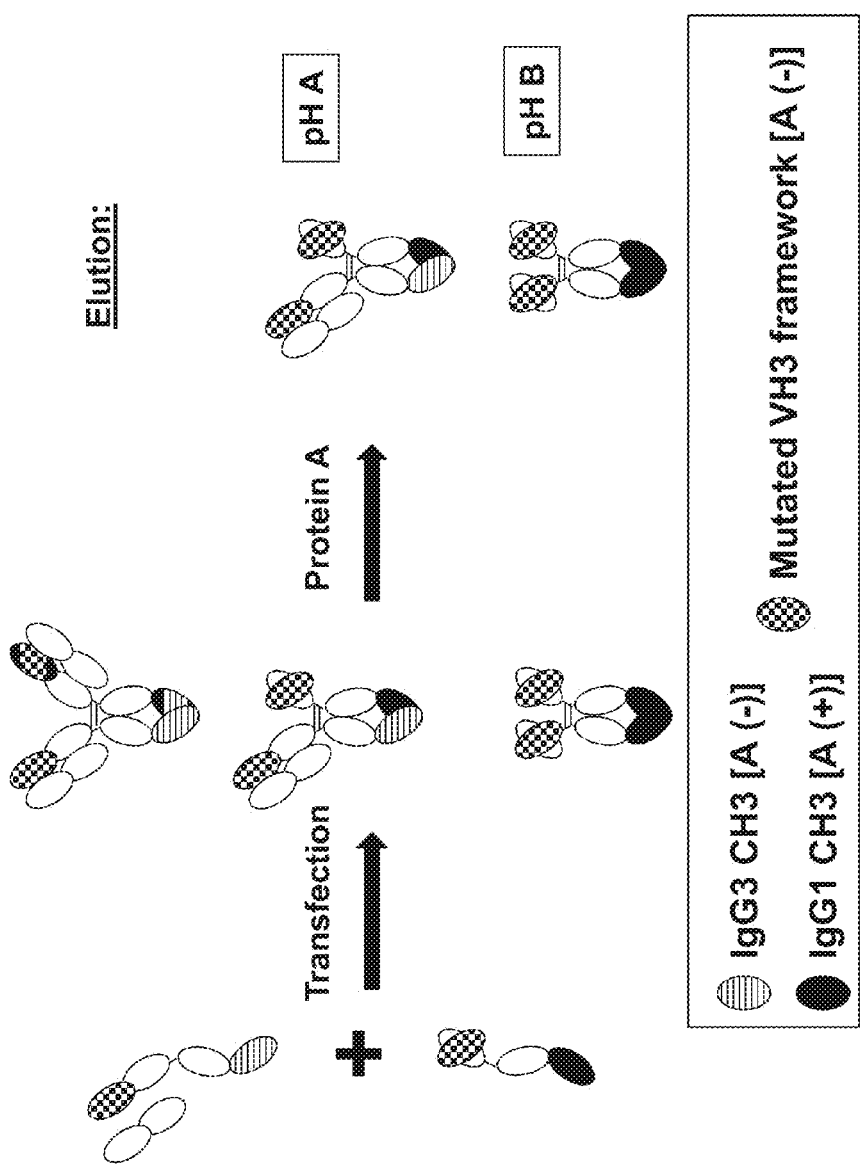

FIG. 5

```
                       1         2         3         4         5
              ....|....|....|....|....|....|....|....|....|....|
Kabat numbering  12345678901234567890123456789012345AB67890123456789 0
Human IGHV1-3    QVQLVQSGAEVKKPGASVKVSCKASGYTFTSYAMH..WVRQAPGQRLEWMGW
Human IGHV2-26   QVTLKESGPVLVKPTETLTLTCTVSGFSLSNARMGVSWIRQPPGKALEWLAH
Human IGHV3-23   EVQLLESGGGLVQPGGSLRLSCAASGFTFSSYAMS..WVRQAPGKGLEWVSA
Human IGHV4-28   QVQLQESGPGLVKPSDTLSLTCAVSGYSISSSNWWG.WIRQPPGKGLEWIGY
Human IGHV5-51   EVQLVQSGAEVKKPGESLKISCKGSGYSFTSYWIG..WVRQMPGKGLEWMGI
Human IGHV6-1    QVQLQQSGPGLVKPSQTLSLTCAISGDSVSSNSAAWNWIRQSPSRGLEWLGR
Human IGHV7-4-1  QVQLVQSGSELKKPGASVKVSCKASGYTFTSYAMN..WVRQAPGQGLEWMGW 6         7         8         9
              ....|....|....|....|....|....|....|....|....|....|
Kabat numbering  12AB345678901234567890123456789012ABC345678901 2345
Human IGHV1-3    INA.GNGNTKYSQKFQGRVTTTRDTSASTAYMELSSLRSEDTAVYYCAR.
Human IGHV2-26   IF..SNDEKSYSTSLKSRLTISKDTSKSQVVLTMTNMDPVDTATYYCARI
Human IGHV3-23   ISG.SGGSTYYADSVKGRFTISRDNSKNTLYLQMNSLRAEDTAVYYCAK.
Human IGHV4-28   IY..YSGSTYYNPSLKSRVTMSVDTSKNQFSLKLSSVTAVDTAVYYCAR.
Human IGHV5-51   IYP.GDSDTRYSPSFQGQVTISADKSISTAYLQWSSLKASDTAMYYCAR.
Human IGHV6-1    TYYRSKWYNDYAVSVKSRITINPDTSKNQFSLQLNSVTPEDTAVYYCAR.
Human IGHV7-4-1  INT.NTGNPTYAQGFTGRFVFSLDTSVSTAYLQICSLKAEDTAVYYCAR.
```

| | KD (pM) |
|---|---|
| Anti-HER2 FAB | 153 ± 9 |
| Anti-HER2 FAB N82aS | 162 ± 19 |
| Anti-HER2 FAB G65S | 142 ± 30 |

FIG. 9A

| Antibody | Back-mutations VH / VL | SEQ ID NO H / L chains | Transient expression (mg/L) | FAB Tm (°C) | HPB-ALL staining relative to OKT3 chimera |
|---|---|---|---|---|---|
| Chimeric OKT3 | N.A. | 25/26 | 20 | 80.7 | +++ |
| VH/VL | - / - | 27/39 | 50 | 88.1 | - |
| VH/VL2 | - / M4L | 27/41 | 47 | 90.6 | - |
| VH/VL3 | - / M4L-F71Y | 27/42 | 43 | 89.8 | + |
| VH1/VL1 | A49G / F71Y | 28/40 | 22 | 90.1 | - |
| VH1/VL2 | A49G / M4L | 28/41 | 42 | 90.5 | - |
| VH1/VL3 | A49G / M4L-F71Y | 28/42 | 40 | 90.7 | + |
| VH2/VL1 | I34M-A49G / F71Y | 29/40 | 51 | 89.5 | - |
| VH2/VL2 | I34M-A49G / M4L | 29/41 | 43 | 90.1 | + |
| VH2/VL3 | I34M-A49G / M4L-F71Y | 29/42 | 42.5 | 89.5 | + |
| VH3/VL1 | A49G-A71T / F71Y | 30/40 | 33.5 | 89.7 | - |
| VH3/VL2 | A49G-A71T / M4L | 30/41 | 42 | 90.4 | - |
| VH3/VL3 | A49G-A71T / M4L-F71Y | 30/42 | 56.5 | 89.8 | + |

FIG. 9B

| Antibody | Back-mutations | SEQ ID NO H / L chains | Transient expression (mg/l) | FAB Tm (°C) | HPB-ALL staining relative to OKT3 chimera |
|---|---|---|---|---|---|
| VH4/VL2 | I34M-A49G-A71T / M4L | 31/41 | 20 | 88.4 | ++ |
| VH4/VL3 | I34M-A49G-A71T / M4L-F71Y | 31/42 | 34 | 88.7 | ++ |
| VH5/VL2 | I34M-A49G-I69L-A71T-T73K / M4L | 32/41 | 40 | 87 | ++ |
| VH5/VL3 | I34M-A49G-I69L-A71T-T73K / M4L-F71Y | 32/42 | 36 | 87.2 | ++ |
| VH5/VL4 | I34M-A49G-I69L-A71T-T73K / M4L-L46R-F71Y | 32/43 | 12 | 80.3 | +++ |
| VH5/VL6 | I34M-A49G-I69L-A71T-T73K / M4L-L46R-L47W-F71Y-P96F | 32/45 | 15.6 | 78.6 | +++ |
| VH5/VL7 | I34M-A49G-I69L-A71T-T73K / M4L-V33M-A34N-F71Y-P96F | 32/46 | 35.4 | 84.1 | ++ |
| VH6/VL3 | I34M-V48I-A49G-I69L-A71T-T73K / M4L-F71Y | 33/42 | 23 | 88.3 | ++ |
| VH6/VL4 | I34M-V48I-A49G-I69L-A71T-T73K / M4L-L46R-F71Y | 33/43 | 14 | 80.8 | +++ |
| VH6/VL5 | I34M-V48I-A49G-I69L-A71T-T73K / M4L-L46R-L47W-F71Y | 33/44 | 26 | 86.1 | ++ |
| VH6/VL6 | I34M-V48I-A49G-I69L-A71T-T73K / M4L-L46R-L47W-F71Y-P96F | 33/45 | 14.8 | 79.1 | +++ |
| VH6/VL7 | I34M-V48I-A49G-I69L-A71T-T73K / M4L-V33M-A34N-F71Y-P96F | 33/46 | 32 | 85.3 | ++ |

FIG. 9C

| Antibody | Back-mutations | SEQ ID NO H / L chains | Transient expression (mg/l) | FAB Tm (°C) | HPB-ALL staining relative to OKT3 chimera |
|---|---|---|---|---|---|
| VH6/VL8 | I34M-V48I-A49G-I69L-A71T-T73K / M4L-L46R-L47W-R66G-F71Y | 33/47 | 7 | 80.6 | +++ |
| VH7/VL3 | I34M-A49G-R58N-I69L-A71T-T73K / M4L-F71Y | 34/42 | 21 | 86.1 | ++ |
| VH7/VL4 | I34M-A49G-R58N-I69L-A71T-T73K / M4L-L46R-L47W-F71Y | 34/43 | 25 | 80.5 | +++ |
| VH7/VL5 | I34M-A49G-R58N-I69L-A71T-T73K / M4L-V33M-A34N-F71Y | 34/44 | 26 | 84.12 | ++ |
| VH8/VL4 | I34M-V48I-A49G-R58Y-I69L-A71T-T73K / M4L-L46R-L47W-F71Y | 35/43 | 7 | 80.9 | +++ |
| VH8/VL8 | I34M-V48I-A49G-R58Y-I69L-A71T-T73K / M4L-L46R-L47W-R66G-F71Y | 35/47 | 23 | 83.5 | +++ |
| VH9/VL8 | I34M-V48I-A49G-R58Y-G65S-I69L-A71T-T73K / M4L-L46R-L47W-R66G-F71Y | 36/47 | 13 | 82 | +++ |
| VH10/VL4 | I34M-V48I-A49G-R58Y-G65S-F67A-I69L-A71T-T73K / M4L-L46R-L47W-F71Y | 37/43 | 7 | 78.6 | +++ |
| VH10/VL8 | I34M-V48I-A49G-R58Y-G65S-F67A-I69L-A71T-T73K / M4L-L46R-L47W-R66G-F71Y | 37/47 | 10 | 80.4 | +++ |
| VH11/VL4 | I34M-V48I-A49G-R58Y-I69L-A71T-T73K-N82aS / M4L-L46R-L47W-F71Y | 38/43 | 8 | 80.3 | +++ |
| VH11/VL8 | I34M-V48I-A49G-R58Y-I69L-A71T-T73K-N82aS / M4L-L46R-L47W-R66G-F71Y | 38/47 | 15 | 82.3 | +++ |

FIG. 9E

| scFv-Fc fusion | SEQ ID NO | Transient expression (mg/L) | scFv Tm (°C) | HPB-ALL staining relative to OKT3 chimera |
|---|---|---|---|---|
| Mouse OKT3 | 52 | 0.35 | - | ++ |
| VH5-VL3 | 53 | 21 | 71.2 | + |
| VH6-VL4 | 54 | 29 | 65.3 | ++ |
| VH6-VL5 | 55 | 27 | 71.2 | ++ |
| VH8-VL4 | 56 | 28 | 66.4 | +++ |
| VH8-VL8 | 57 | 28 | 69.2 | +++ |

FIG. 10A

| Antibody | Back-mutations VH/VL | SEQ ID NO H/L chains | Format | Transient expression (mg/L) | SPR-Binding to human/cynomolgus monkey CD3 epsilon 1-26 Fc proteins |
|---|---|---|---|---|---|
| Chimeric SP34 | N.A. | 62/63 | IgG1 | 7 | ++++ |
| VH1/VL1 | -/- | 64/69 | IgG1 | 8 | + |
| VH1/VL2 | -/Q89A | 64/70 | IgG1 | 1 | ++++ |
| VH1/VL3 | -/deleted 8P | 64/71 | IgG1 | 0.5 | - |
| VH1/VL4 | -/deleted 8P-Q89A | 64/72 | IgG1 | 0.5 | ++++ |
| VH1/VL5 | -/A2I-Q89A | 64/73 | IgG1 | 2.6 | ++++ |
| VH1/VL6 | -/F44P-Q89A | 64/74 | IgG1 | 0.9 | ++++ |
| VH1/VL7 | -/A2I-F44P-Q89A | 64/75 | IgG1 | No expression | Not tested |
| VH1/VL8 | -/L66G-Q89A | 64/76 | IgG1 | 0.8 | + |
| VH1/VL9 | -/A2I-L66G-Q89A | 64/77 | IgG1 | No expression | Not tested |
| VH1/VL10 | -/F87Y-Q89A | 64/78 | IgG1 | 6 | ++++ |
| VH1/VL11 | -/L66G-D69T-Q89A | 64/79 | IgG1 | 0.8 | + |
| VH1/VL12 | -/D69T-Q89A | 64/80 | IgG1 | 1.5 | ++ |
| VH1/VL13 | -/S25A/Q89A | 64/81 | IgG1 | 1 | +++ |
| VH1/VL14 | -/G46L-Q89A | 64/82 | IgG1 | 3 | - |
| VH1/VL15 | -/E38Q-Q89A | 64/83 | IgG1 | 3 | ++++ |
| VH1/VL16 | -/A2I-D69T-Q89A | 64/84 | IgG1 | 0.5 | + |
| VH1/VL17 | -/A2I-S25A-Q89A | 64/85 | IgG1 | 1 | ++ |
| VH1/VL18 | -/A2I-D69T-F87Y-Q89A | 64/86 | IgG1 | 1 | ++ |
| VH1/VL19 | -/A2I-D69T-F87Y-Q89A | 64/87 | IgG1 | 0.2 | + |
| VH1/VL20 | -/A2I-E38Q-D69T-F87Y-Q89A | 64/88 | IgG1 | No expression | Not tested |
| VH1/VL21 | -/A2I-F87Y-Q89A | 64/89 | IgG1 | 8 | ++++ |
| VH1/VL22 | -/A2I-E38Q-F87Y-Q89A | 64/90 | IgG1 | 2 | +++ |

FIG. 10B

| ScFv-Fc fusion | Back-mutations VH/VL | SEQ ID NO H/L chains | Format | Transient expression (mg/L) | SPR-Binding to human/cynomolgus monkey CD3 epsilon 1-26_Fc proteins |
|---|---|---|---|---|---|
| VH2/VL21 | G65S /A2I-F87Y-Q89A | 91 | scFv-Fc | 5 | +++ |
| VH3/VL23 | G65S-W100eY /A2I-F87Y-Q89A-W91F | 92 | scFv-Fc | 10 | ++ |
| VH4/VL23 | G65S-W100eF /A2I-F87Y-Q89A-W91F | 93 | scFv-Fc | 5.5 | ++++ |
| VH5/VL23 | W100eY/A2I-F87Y-Q89A-W91F | 94 | scFv-Fc | 15 | ++++ |
| VH1/VL24 | -/A2I-T27A-G27aA- F87Y-Q89A | 349 | scFvFc | No expression | Not tested |
| VH1/VL25 | -/A2I-V27cA-T28A- F87Y-Q89A | 350 | scFvFc | 4 | - |
| VH1/VL26 | -/A2I-T29A-S30A- F87Y-Q89A | 351 | scFvFc | 12 | ++++ |
| VH1/VL27 | -/A2I-N31A-Y32A- F87Y-Q89A | 95 | scFv-Fc | 2 | - |
| VH1/VL28 | -/A2I-N52A-K53A- F87Y-Q89A | 96 | scFv-Fc | No expression | Not tested |
| VH1/VL29 | -/A2I-R54A-P56A- F87Y-Q89A | 97 | scFv-Fc | 4 | - |
| VH1/VL30 | -/A2I-Y92A-S93A- F87Y-Q89A | 98 | scFv-Fc | 2 | + |
| VH1/VL31 | -/A2I-N94A -F87Y-Q89A | 99 | scFv-Fc | 2 | ++ |
| VH5/VL32 | W100eY/A2I-T29A-S30A-T51A-F87Y-Q89A-W91F | 100 | scFv-Fc | 25 | ++++ |

FIG. 11E
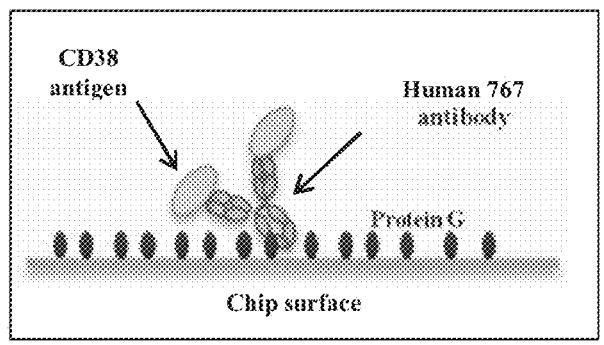
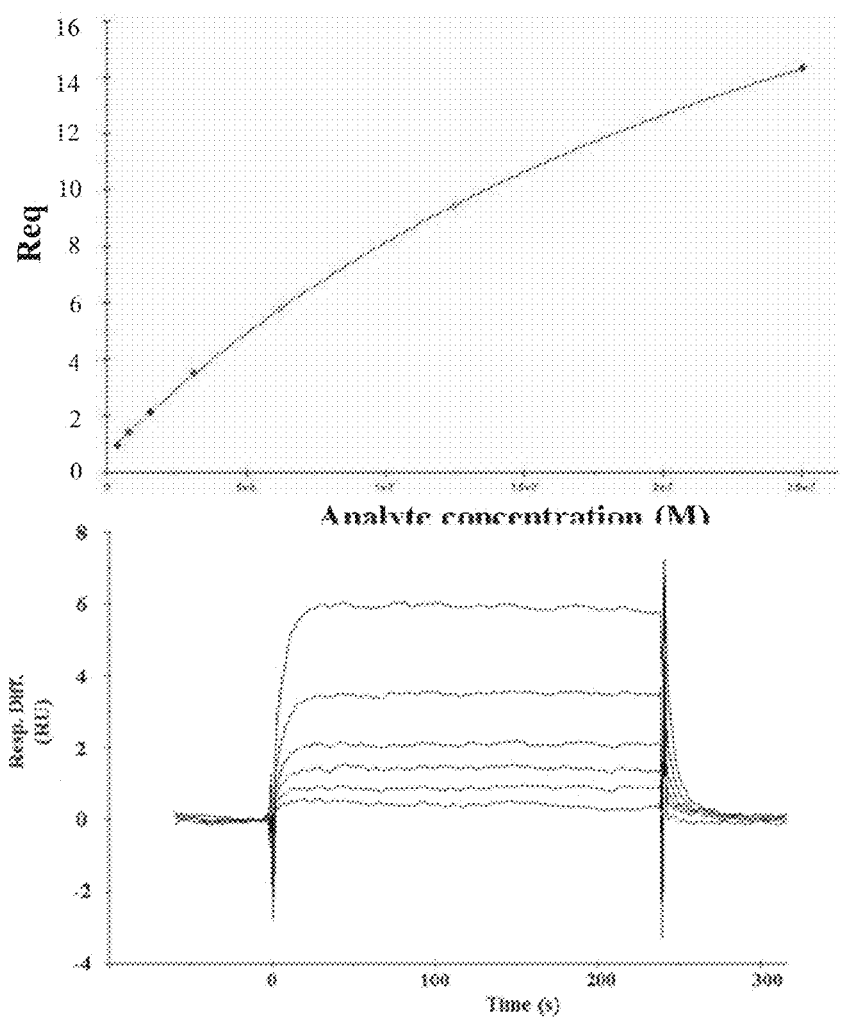

FIG. 11F
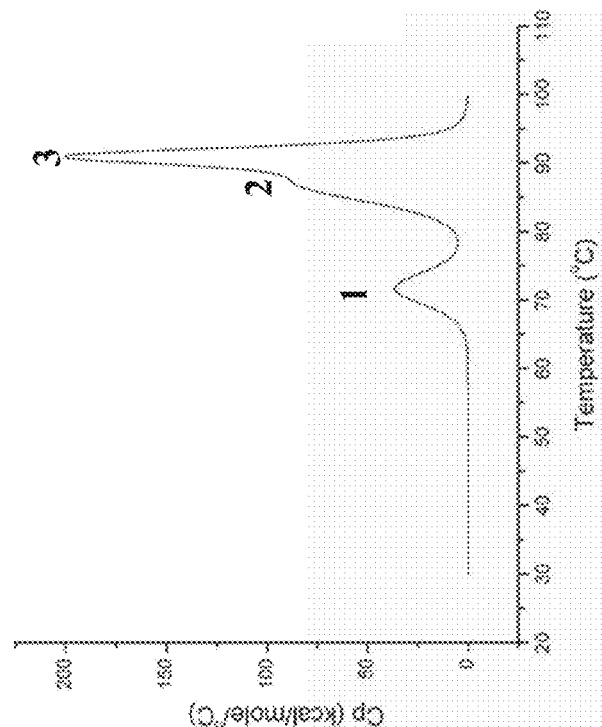
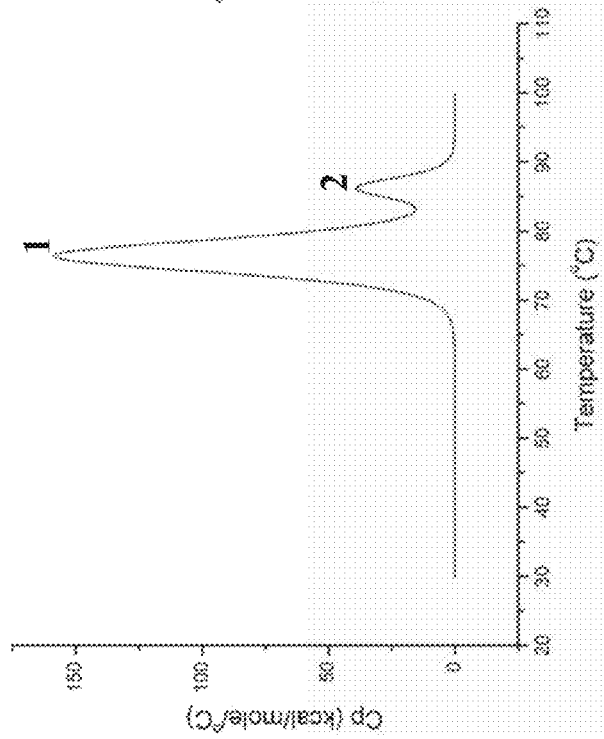

FIG. 11G
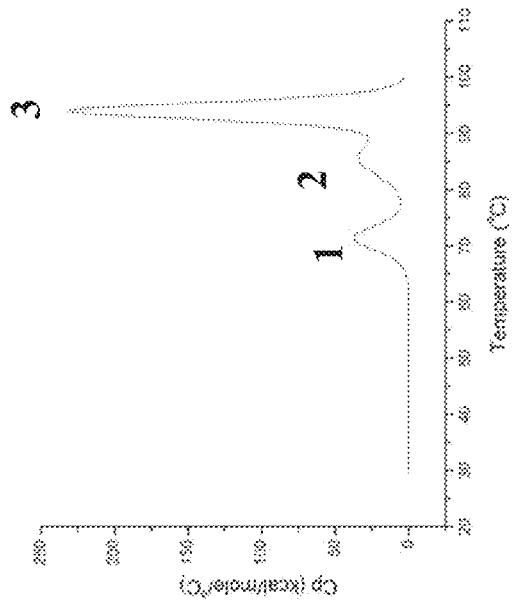
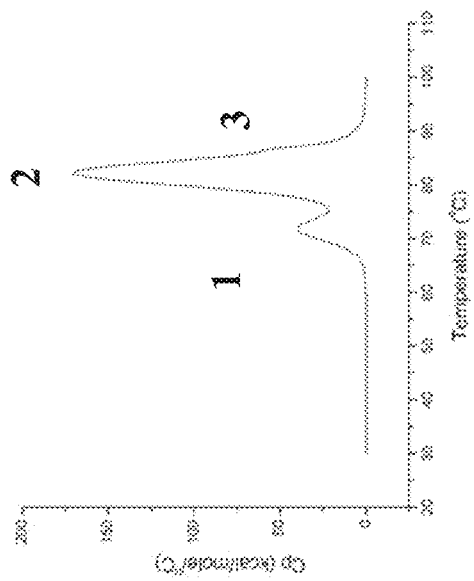

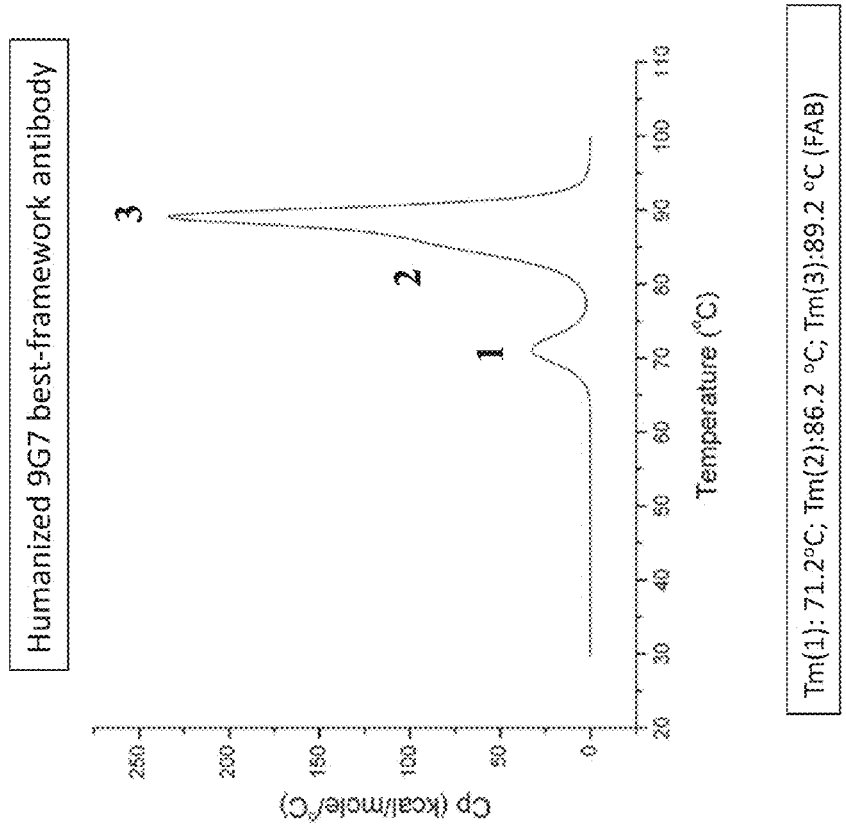

FIG. 11J

| | Chimeric 9G7 antibody | Humanized 9G7 best-fit antibody | Humanized 9G7 best-framework antibody |
|---|---|---|---|
| HC/LC SEQ ID NO | 126/127 | 124/128 | 131/132 |
| Transient expression levels (mg/l) | 20 | 11 | 17 |
| KD human CD3 epsilon 1-26_Fc fusion protein (nM) | 0.4 | 0.5 | 0.4 |
| KD cynomolgus monkey CD3 epsilon 1-26_Fc fusion protein (nM) | 1 | 3.2 | 1 |
| FAB Tm (°C) | 82.2 | 94 | 89.2 |

FIG. 16A
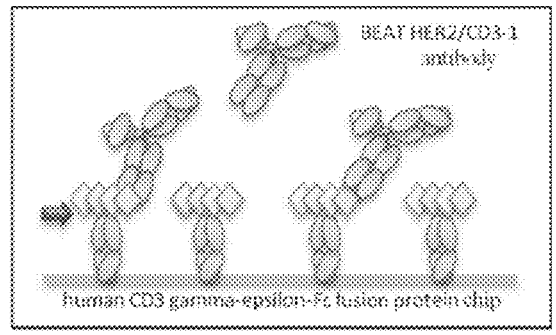
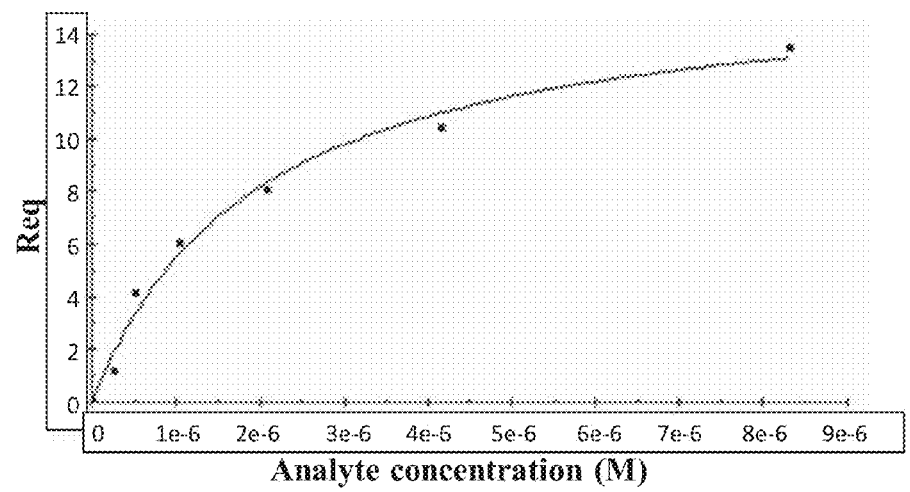
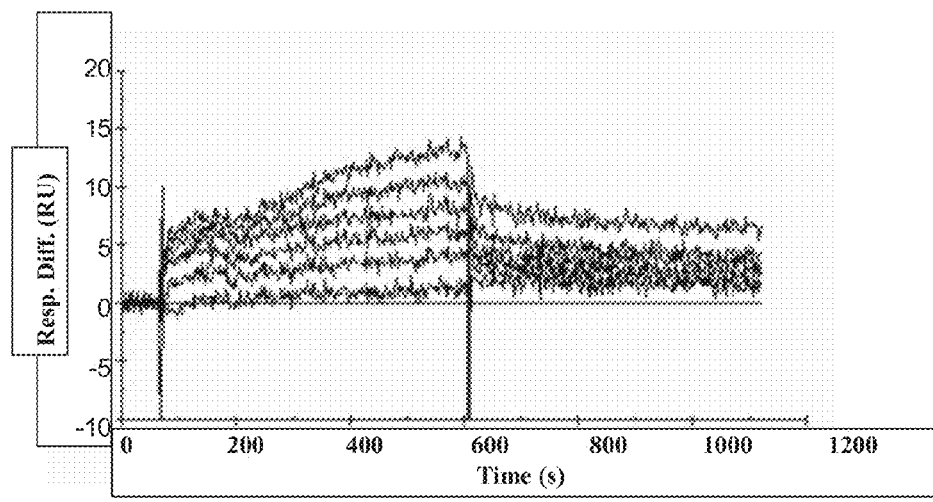

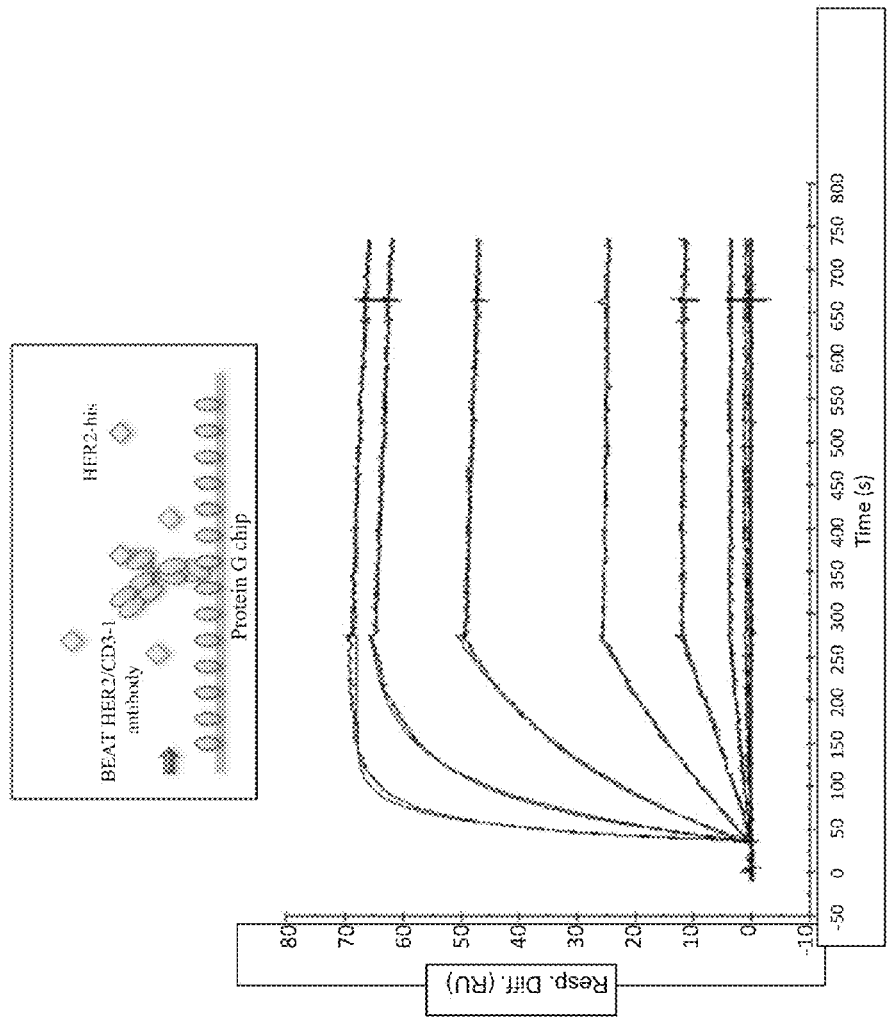

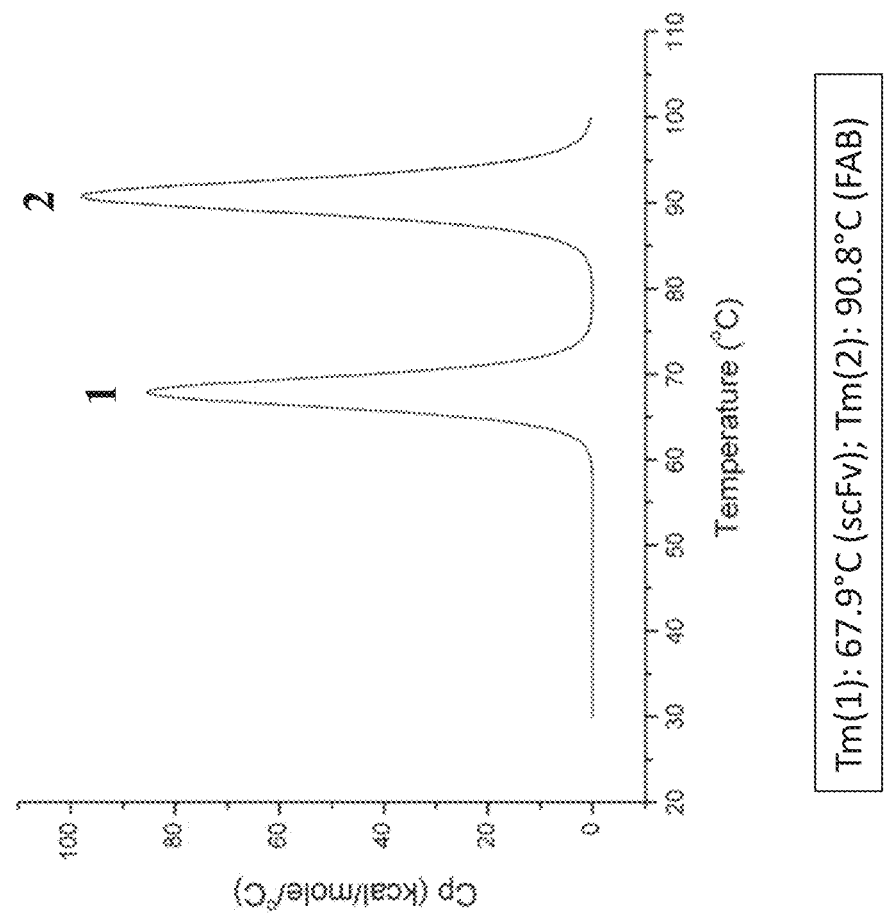

PRODUCTION OF T CELL RETARGETING HETERO-DIMERIC IMMUNOGLOBULINS

CROSS-REFERENCE TO RELATED APPLICATIONS

This application claims the benefit of European Patent Application No. 13191386.5, filed Nov. 4, 2013, which is incorporated by reference herein in its entirety.

REFERENCE TO A SEQUENCE LISTING SUBMITTED ELECTRONICALLY VIA EFS-WEB

The content of the electronically submitted sequence listing (Name: 3305.0170001 Patent-In SL_ST25.txt; Size: 680,803 bytes; and Date of Creation: Jun. 16, 2016) is herein incorporated by reference in its entirety.

FIELD OF THE INVENTION

The present invention relates to hetero-dimeric immunoglobulins that target both a component of the human CD3 antigen and a disease associated antigen and methods of making the same.

BACKGROUND OF THE INVENTION

T cell redirected killing is a desirable mode of action in many therapeutic areas. Various bispecific antibody formats have been shown to mediate T cell redirection both in pre-clinical and clinical investigations (May C et al., (2012) Biochem Pharmacol, 84(9): 1105-12; Frankel S R & Baeuerle P A, (2013) Curr Opin Chem Biol, 17(3): 385-92). All T cell retargeting bispecific antibodies or fragments thereof are engineered to have at least two antigen binding sites wherein one site binds a surface antigen on a target cell and the other site binds a T cell surface antigen. Amongst T cell surface antigens, the human CD3 epsilon subunit from the TCR protein complex has been the most targeted to redirect T cell killing.

Many bispecific antibody formats have been used to redirect T cell killing, these mainly include tandem of scFv fragments and diabody based formats with only few examples of Fc-based bispecific antibody formats reported (Moore P A et al., (2011) Blood, 117(17): 4542-51; May C et al., (2012) supra; Frankel S R & Baeuerle P A, (2013) supra). Bispecific formats that will encompass a human Fc region will have longer circulation half-lives which may result in enhanced efficacy and/or less frequent dosing regimens. Among possible Fc-based bispecific formats, one preferred format to redirect T cell killing is the so-called heavy chain hetero-dimer format. This format is of particular interest as it does not allows aggregation of multiple copies of human CD3 molecules at the T cell surface thereby preventing any T cell inactivation (Klein C et al., (2012) MAbs, 4(6): 653-63).

The first described method to engineer heavy chain hetero-dimers is a method known as the "knob-into-hole" method (PCT Publication No: WO199627011; Merchant A M et al., (1998) Nat Biotechnol, 16(7): 677-81). Recently a chemical method known as the FAB-arm exchange method wherein two antibodies are combined into one bispecific antibody via reduction and in vitro reshuffling of half-immunoglobulins has been reported (PCT Publication Nos: WO2008119353 (Schuurman J et al.) and WO2013060867 (Gramer M et al.); Labrijn A F et al., (2013) Proc Natl Acad Sci USA, 110(13): 5145-50).

Both methods and derivatives thereof are currently inadequate to produce Fc-based bispecific antibody formats in mammalian cell hosts. When expressing "knob-into-hole" heavy chain hetero-dimers in mammalian cell hosts, bispecific antibody recovery is impaired by the presence of homo-dimers (Jackman J et al., (2010) J Biol Chem, 285 (27): 20850-9; Klein C et al., supra). The FAB-arm exchange method and derivatives thereof suffers from the same drawback with the added problem of having first to produce the two "monospecific" antibodies separately.

When developing bispecific antibodies that redirect T cell killing via the engagement of a CD3 subunit, it is essential that no homo-dimers specific for the CD3 subunit are present in the final drug product. In the case of targeting the CD3 epsilon subunit, traces of anti-human CD3 epsilon antibody species (monospecific and bivalent for the human CD3 epsilon antigen) may trigger transient T cell activation and cytokine release before leading to T cell apoptosis thereby interfering with the goal of a controlled and specific T cell activation. Production of stable and safe Fc-based bispecific antibodies that efficiently redirect T cell killing remains a challenge to the pharmaceutical industry with respect to purity and yields. Accordingly there remains a need for a technology to efficiently produce anti-human CD3 based heavy chain hetero-dimers free of anti-human CD3 homo-dimers wherein the secreted bispecific antibody product is readily isolated from the cell culture supernatant from a recombinant mammalian host cell line.

Techniques to purify heavy chain hetero-dimers over homo-dimers based on a differential affinity for a reagent have been described. The first example of known differential affinity purification technique involved the use of two different heavy chains from two different animal species, wherein one of which does not bind the affinity reagent Protein A (Lindhofer H et al., (1995) J Immunol, 155(1): 219-225). The same authors also described the use of two different heavy chains originating from two different human immunoglobulin isotypes (IGHG1 and IGHG3), one of which does not bind the affinity reagent Protein A (IGHG3; see U.S. Pat. No. 6,551,592 Lindhofer H et al.). More recently, a variation of this technique was reported by Davis S et al. (PCT Publication No: WO2010151792) and made use of the two amino acid substitutions H435R and Y436F described by Jendeberg (1997) (Jendeberg L. et al. (1997) J Immunol Methods, 201(1): 25-34) to abrogate the affinity for the reagent Protein A in one of the hetero-dimer heavy chains.

The preferred known differential Protein A affinity purification technique of the present invention corresponds to a technique wherein all three species i.e. the two homo-dimeric species and the hetero-dimer of interest differ in their total number of Protein A binding sites by at least one site and wherein one of the two homo-dimeric species has no Protein A binding site and therefore does not bind Protein A (as shown in FIG. 1).

Drug stability is an important aspect of successful pharmaceutical development and VH3 based immunoglobulins or fragments thereof are of major importance to the biological drug industry. Therapeutic antibodies based on the VH3 subclass have been extensively developed as these frameworks bind Protein A and facilitate the testing of antibody fragments before their formatting into immunoglobulins; for example, many synthetic antibody phage display libraries used for antibody discovery are based on the VH3 subclass.

In addition VH3 based antibodies are often selected for their good expression and stability over other known heavy chain variable domain subclasses.

Although a VH3 domain has only one Protein A binding site with a weaker affinity when compared to a Fc region which has two sites with a stronger affinity (Roben P W et al., (1995) J Immunol, 154(12): 6437-45), there is enough affinity to interfere with the known differential Protein A affinity purification techniques. When dealing with the purification of hetero-dimers of heavy chains wherein the heavy chain engineered in its Fc region to have no binding for Protein A encompasses one VH3 based antigen binding site, then Protein A binding is restored via the VH3 domain and the preferred technology described in FIG. 1 and above is no longer useful (FIG. 2A). In this instance, abrogating Protein A binding in the VH3 based antigen binding site provides a straightforward solution and allows to keep the initial architecture of the desired hetero-dimer (FIG. 2B). Alternatively, the heavy chain hetero-dimer can be re-engineered to have the VH3 based antigen binding site located on the heavy chain that binds Protein A in its Fc region (FIG. 2C; note that a VH3 domain has a weaker affinity for Protein A compared to a Fc monomer hence the hetero-dimer of interest still elutes at a separate pH value from the other homo-dimeric species, typically at pH 4, while the homo-dimeric species that binds Protein A now encompasses two additional Protein A binding sites and elutes at a pH value≤3).

More importantly, when dealing with the purification of hetero-dimers of heavy chains wherein both heavy chains encompass a VH3 based antigen binding site, then the relocation strategy described above may only be partially helpful (FIG. 2D and FIG. 15B). Protein A based differential purification is only enabled when Protein A binding in at least one (FIG. 2E) or both (FIG. 2F) VH3 based antigen binding sites is abrogated.

Accordingly, there remains a need to abrogate Protein A binding within VH3 domains when undertaking the production of hetero-dimers of heavy chains encompassing this variable domain subclass.

SUMMARY OF THE INVENTION

The present invention provides new anti-human CD3 bispecific antibodies comprising a second binding arm which can recognise and bind to a disease associated antigen.

In the context of the present invention a disease associated antigen means any antigen or epitope associated with a pathological state such as an oncogenic marker or a marker of some other metabolic or immunological dysfunction. In addition a disease marker my also relate to an infectious disease such as a pathogenic virus or bacteria.

In accordance with the present invention the two binding arms of the anti-human CD3 bispecific antibody each comprise an immunoglobulin constant region and wherein the first arm or polypeptide binds to protein A and the second arm or polypeptide does not bind to protein A.

According to the present invention the binding of the first polypeptide to protein A and the lack of binding of the second polypeptide to protein A, is not intended to mean that the second polypeptide may not have some residual binding to protein A and it is instead intended that the second polypeptide binds less well to protein A in comparison to the first arm.

According to the present invention the first and second polypeptides of the hetero-dimeric immunoglobulin or fragment thereof, comprise an engineered immunoglobulin constant region with a modified CH3 region having a protein-protein interface that favours hetero-dimer formation over homo-dimer formation. In a preferred embodiment, the present invention provides a hetero-dimeric immunoglobulin or fragment thereof wherein the first and second polypeptides comprise an engineered immunoglobulin constant region with a modified CH3 domain having a protein-protein interface, wherein the protein-protein interface of the first polypeptide comprises an amino acid substitution at a position selected from the group consisting of: 3, 5, 7, 20, 22, 26, 27, 79, 81, 84, 84.2, 85.1, 86, 88 and 90 (IMGT® numbering), and wherein the protein-protein interface of the second polypeptide comprises an amino acid substitution at a position selected from the group consisting of: 3, 5, 7, 20, 22, 26, 27, 79, 81, 84, 84.2, 84.4, 85.1, 86, 88 and 90 (IMGT® numbering).

Preferably wherein the protein-protein interface of the second polypeptide comprises an amino acid substitution at position 84.4 and at least one further substitution at a position selected from the group consisting of: 3, 5, 7, 20, 22, 26, 27, 79, 81, 84, 84.2, 85.1, 86, 88 and 90 (IMGT® numbering).

In a further embodiment, the present invention provides a hetero-dimeric immunoglobulin or fragment thereof, wherein the first and second polypeptides comprise an engineered immunoglobulin constant region with a modified CH3 domain having a protein-protein interface, wherein the protein-protein interface of the first polypeptide comprises an amino acid substitution at position 88 and at a position selected from the group consisting of: 3, 5, 7, 20, 22, 26, 27, 79, 81, 84, 84.2, 85.1, 86 and 90 (IMGT® numbering), and wherein the protein-protein interface of the second polypeptide comprises an amino acid substitution at position 85.1 and/or 86 and at a position selected from the group consisting of 3, 5, 7, 20, 22, 26, 27, 79, 81, 84, 84.2, 84.4, 88 and 90 (IMGT® numbering).

According to a further aspect of the present invention the epitope binding region of the first polypeptide binds the CD3 protein complex and the epitope binding region of the second polypeptide binds a disease associated antigen or wherein the epitope binding region of the first polypeptide binds a disease associated antigen and the epitope binding region of the second polypeptide binds the CD3 protein complex; and wherein the epitope binding region that binds the CD3 protein complex comprises a heavy chain CDR1 comprising the amino acid sequence of SEQ ID NO: 194, a heavy chain CDR2 comprising the amino acid sequence of SEQ ID NO: 195 and a heavy chain CDR3 comprising the amino acid sequence of SEQ ID NO: 196, and a light chain CDR1 comprising the amino acid sequence of SEQ ID NO: 197, a light chain CDR2 comprising the amino acid sequence of SEQ ID NO: 198 and a light chain CDR3 comprising the amino acid sequences of: SEQ ID NO: 199; or wherein the epitope binding region that binds the CD3 protein complex comprises a heavy chain CDR1 comprising the amino acid sequence of SEQ ID NO: 200, a heavy chain CDR2 comprising the amino acid sequence of SEQ ID NO: 201 and a heavy chain CDR3 comprising the amino acid sequence of SEQ ID NO: 202, and a light chain CDR1 comprising the amino acid sequence of SEQ ID NO: 203, a light chain CDR2 comprising the amino acid sequence of SEQ ID NO: 204 and a light chain CDR3 comprising the amino acid sequences of: SEQ ID NO: 205; or wherein the epitope binding region that binds the CD3 protein complex comprises a heavy chain CDR1 comprising the amino acid sequence of SEQ ID NO: 352, a heavy chain CDR2 comprising the amino acid sequence of SEQ ID NO: 353 and a heavy chain CDR3 comprising the amino acid sequence of SEQ ID NO: 354, and a light chain CDR1 comprising the amino acid sequence of SEQ ID NO: 355, a light chain CDR2 comprising the amino acid sequence of SEQ ID NO: 356 and a light chain CDR3 comprising the amino acid sequences of SEQ ID NO: 357.

Use of these new anti-human CD3 bispecific antibodies is not limited to but includes treatments of various human cancers and autoimmune and inflammatory diseases. The specific destruction of cancer cells over healthy cells and tissues represents a primary objective in oncology. Therapeutics that could safely redirect T cell killing against tumour associated cell surface antigens may offer improved clinical efficacy. Known areas of clinical unmet needs in oncology include but are not limited to breast cancer, metastatic breast cancer, ovarian cancer, pancreatic cancer, lung cancer, lymphomas and multiple myeloma. Elimination of disease-causing T cells could be more beneficial than inhibiting T cell differentiation in treating autoimmune and inflammatory diseases such as psoriasis, multiple sclerosis and diabetes.

A preferred set of disease associated antigens come from the gene products CD33, TROP2, CD105, GD2, GD3, CEA, VEGFR1, VEGFR2, NCAM, CD133, CD123, ADAM17, MCSP, PSCA, FOLR1, CD19, CD20, CD38, EpCAM, HER2, EGFR, PSMA, IgE, Integrin a4b1, CCR5, LewisY, FAP, MUC-1, Wue-1, MSP, EGFRvIII, P glycoprotein, AFP, ALK, BAGE proteins, CD30, CD40, CTLA4, ErbB3, ErbB4, Mesothelin, OX40, CA125, CAIX, CD66e, cMet, EphA2, HGF/SF, MUC1, Phosphatidylserine, TAG-72, TPBG, β-catenin, brc-abl, BRCA1, BORIS, CA9, caspase-8, CDK4, Cyclin-B1, CYP1B1, ETV6-AML, Fra-1, FOLR1, GAGE-1, GAGE-2, GloboH, glypican-3, GM3, gp100, HLA/B-raf, HLA/k-ras, HLA/MAGE-A3, hTERT, LMP2, MAGE1, MAGE2, MAGE3, MAGE4, MAGE6, MAGE12, MART-1, ML-IAP, Muc2, Muc3, Muc4, Muc5, Muc16, MUM1, NA17, NY-BR1, NY-BR62, NY-BR-85, NY-ESO1, p15, p53, PAP, PAX3 PAX5, PCTA-1, PLAC1, PRLR, PRAME, RAGE proteins, Ras, RGS5, Rho, SART-1, SART-3, Steap-1, Steap-2, survivin, TAG-72, TGF-β, TMPRSS2, Tn, TRP-1, TRP-2, tyrosinase, uroplakin-3.

A hetero-dimeric immunoglobulin or fragment thereof according to the invention, wherein the epitope binding region that binds a disease associated antigen comprises heavy chain CDR1, CDR2 and CDR3 amino acid sequences and light chain CDR1, CDR2 and CDR3 amino acid sequences, respectively, selected from the group consisting of:
  i) SEQ ID NOs: 206-211;
  ii) SEQ ID NOs: 212-217;
  iii) SEQ ID NOs: 218-223;
  iv) SEQ ID NOs: 224-229;
  v) SEQ ID NOs: 230-235;
  vi) SEQ ID NOs: 236-241;
  vii) SEQ ID NOs: 242-247;
  viii) SEQ ID NOs: 248-253;
  ix) SEQ ID NOs: 254-259;
  x) SEQ ID NOs: 260-265;
  xi) SEQ ID NOs: 266-271; and
  xii) SEQ ID NOs: 272-277;

In accordance with a further aspect of the present invention the constant region of the second polypeptide of the hetero-dimeric immunoglobulin or fragment thereof, comprises an IgG3 CH3 region.

In accordance with a further aspect of the present invention the constant region of the second polypeptide of the hetero-dimeric immunoglobulin or fragment thereof, comprises a CH3 region other than that from IgG, and the non-IgG3 CH3 region comprises at least one substitution so as to decrease/abolish protein A binding.

According to a further aspect of the present invention the epitope binding region of second polypeptide of the hetero-dimeric immunoglobulin or fragment thereof comprises a VH3 region comprising at least one modification that reduces protein A binding.

The inventors have shown that VH3 based antigen binding sites can be readily produced and purified with a high degree of purity in a single Protein A chromatography step. These antibodies may exhibit higher efficacy over current therapies in addition to their ease of production.

The present invention also provides a method to produce anti-human CD3 bispecific heavy chain hetero-dimers having at least one VH3 based antigen binding site from a recombinant mammalian host cell line wherein the bispecific antibody product is readily isolated after a single Protein A chromatography step with a high degree of purity.

In particular the modified VH3 region comprises an amino acid substitution selected from the group consisting of: 57, 65, 81, 82a and combination 19/57/59 (Kabat numbering) and even more preferably wherein the modified VH3 region comprises an amino acid substitution selected from the group consisting of: 57A, 57E, 65S, 81E, 82aS and combination 19G/57A/59A (Kabat numbering).

According to a further aspect of the present invention the hetero-dimeric immunoglobulin or fragment thereof, may comprise further substitutions wherein the heavy chain variable framework region comprises an amino acid substitution selected from the group consisting of: I34M, V48I, A49G, R58N/Y, I69L, A71T and T73K (Kabat numbering) and the light chain variable framework region comprises an amino acid substitution selected from the group consisting of: M4L, V33M, A34N, L46R, L47W, T51A, R66G, F71Y and P96F (Kabat numbering); or wherein the heavy chain variable framework region comprises the amino acid substitutions I34M, A49G and A71T (Kabat numbering) and the light chain variable framework region comprises the amino acid substitutions M4L, L46R, L47W and F71Y (Kabat numbering).

In a further embodiment, the epitope binding region that binds to the CD3 protein complex comprises a heavy chain variable framework region that is the product of or derived from the human VH3 subclass. Preferably the heavy chain variable framework region is the product of or derived from human IGHV3-23. More preferably, the heavy chain variable framework region is the product of or derived from human IGHV3-23*04 (SEQ ID NO: 22). The heavy chain variable framework region comprises at least one amino acid modification from the corresponding framework region of the heavy chain variable region of the corresponding murine antibody comprising the amino acid sequence of SEQ ID NO: 18 or SEQ ID NO: 60.

In a preferred embodiment, the epitope binding region of the first polypeptide that binds to the CD3 protein complex comprises a light chain variable framework region that is the product of or derived from the human VK1 subclass or the human VK3 subclass. Preferably the light chain variable framework region is the product of or derived from human VK1-39 or VK3-20. More preferably the light chain variable framework region is the product of or derived from human IGKV1-39*01 (SEQ ID NO: 23) or IGKV3-20*01 (SEQ ID NO: 24). The light chain variable framework region comprises at least one amino acid modification from the corresponding framework region of the light chain variable region of the corresponding murine antibody comprising the amino acid sequence of SEQ ID NO: 19 or SEQ ID NO: 61.

In a preferred embodiment, the epitope binding region that binds to the CD3 protein complex comprises a humanized heavy chain variable domain having the back mutations selected from the group consisting of: I34M, V48I, A49G, R58N/Y, I69L, A71T and T73K (Kabat numbering) and a humanized light chain variable domain having the back mutations selected from the group consisting of: M4L, V33M, A34N. L46R, L47W, R66G, F71Y and P96F (Kabat numbering). More preferably, the epitope binding region that binds to the CD3 protein complex comprises a humanized heavy chain variable domain having the back mutations I34M, A49G and A71T (Kabat numbering) and a humanized light chain variable domain having the back mutations M4L, L46R, L47W and F71Y (Kabat numbering).

According to a further aspect of the present invention the epitope binding region that binds the CD3 protein complex of the hetero-dimeric immunoglobulin or fragment thereof, comprises a heavy chain variable region comprising the amino acid sequence of SEQ ID NO: 48, and a light chain variable region comprising the amino acid sequence of SEQ ID NO: 51; or wherein the epitope binding region that binds the CD3 protein complex comprises a heavy chain variable region comprising the amino acid sequence of SEQ ID NO: 49, and a light chain variable region comprising the amino acid sequence of SEQ ID NO: 51; or wherein the epitope binding region that binds the CD3 protein complex comprises a heavy chain variable region comprising the amino acid sequence of SEQ ID NO: 358, and a light chain variable region comprising the amino acid sequence of SEQ ID NO: 51; or wherein the epitope binding region that binds the CD3 protein complex comprises a heavy chain variable region comprising the amino acid sequence of SEQ ID NO: 101, and a light chain variable region comprising the amino acid sequence of SEQ ID NO: 105; or wherein the epitope binding region that binds the CD3 protein complex comprises a heavy chain variable region comprising the amino acid sequence of SEQ ID NO: 103, and a light chain variable region comprising the amino acid sequence of SEQ ID NO: 106; or wherein the epitope binding region that binds the CD3 protein complex comprises a heavy chain variable region comprising the amino acid sequence of SEQ ID NO: 104, and a light chain variable region comprising the amino acid sequence of SEQ ID NO: 106.

The CD3 protein complex comprises a number of subunits, for example, delta, epsilon and gamma. In a preferred embodiment, the epitope binding region that binds to the CD3 protein complex binds to the CD3 epsilon subunit.

An epitope binding region as described herein includes the combination of one or more heavy chain variable domains and one or more complementary light chain variable domains which together form a binding site which permits the specific binding of the hetero-dimeric immunoglobulin or fragment thereof to one or more epitopes. In an embodiment of the present invention, the epitope binding region of the first poly peptide comprises a FAB and the epitope binding region of the second polypeptide comprises a scFv. Alternatively, the epitope binding region of the first poly peptide comprises a scFv and the epitope binding region of the second polypeptide comprises a FAB.

In one embodiment, the epitope binding region that binds a disease associated antigen binds to HER2. The epitope binding region comprises a heavy chain variable framework region that is the product of or derived from the human VH3 subclass, preferably human VH3-23, more preferably human IGHV3-23*04 (SEQ ID NO: 22), and a light chain variable framework region that is the product of or derived from the human VK1 subclass, preferably human VK1-39, more preferably human IGKV1-39*01 (SEQ ID NO: 23).

In a preferred embodiment, the epitope binding region that binds the disease associated antigen HER2 comprises a heavy chain variable domain comprising the amino acid sequence of SEQ ID NO: 20 and a light chain variable domain comprising the amino acid sequence of SEQ ID NO: 21. In a further preferred embodiment, the epitope binding region that binds HER2 may comprise a heavy chain variable domain and a light chain variable domain joined by a $G_4S$ linker forming a scFv fragment comprising the amino acid sequence of SEQ ID NO: 107. Preferably, the variable domain of the scFv fragment comprises a modification to abrogate binding to Protein A, wherein the amino acid substitution is 65S (Kabat numbering) and wherein the scFv fragment comprises the amino acid sequence of SEQ ID NO: 109 or wherein the amino acid substitution is 82aS (Kabat numbering) and wherein the scFv fragment comprises the amino acid sequence of SEQ ID NO: 111.

In particular wherein said Herceptin binding arm comprises a heavy chain variable region encoded by SEQ ID NO: 20 and a light chain variable region encoded by SEQ ID NO: 21.

In another embodiment, the epitope binding region that binds a disease associated antigen binds to CD38. The epitope binding region comprises a heavy chain variable framework region that is the product of or derived from the human VH3 subclass, preferably human VH3-23, more preferably human IGHV3-23*04 (SEQ ID NO: 22). The heavy chain variable framework region comprises at least one amino acid modification from the corresponding framework region of the heavy chain variable region of the corresponding murine antibody comprising the amino acid sequence of SEQ ID NO: 112 or 114 or 122. The epitope binding region further comprises a light chain variable framework region that is the product of or derived from the human VK1 subclass, preferably human VK1-39, more preferably human IGKV1-39*01 (SEQ ID NO: 23). The light chain variable framework region comprises at least one amino acid modification from the corresponding framework region of the light chain variable region of the corresponding murine antibody comprising the amino acid sequence of SEQ ID NO: 113 or 115 or 123.

In particular the CD38 binding polypeptide comprises variable heavy chain domain and variable light chain domain pair encoded by SEQ ID NOs: 116/117, 129/130, 133/134 and 135/136.

In one embodiment, the epitope binding region that binds a disease associated antigen binds to OX40. The epitope binding region comprises a heavy chain variable framework region that is the product of or derived from the human VH3 subclass, preferably human VH3-23, more preferably human IGHV3-23*04 (SEQ ID NO: 22). The heavy chain variable framework region comprises at least one amino acid modification from the corresponding framework region of the heavy chain variable region of the corresponding murine antibody comprising the amino acid sequence of SEQ ID NO: 139. The epitope binding region further comprises a light chain variable framework region that is the product of or derived from the human VK1 subclass, preferably human VK1-39, more preferably human IGKV1-39*01 (SEQ ID NO: 23). The light chain variable framework region comprises at least one amino acid modification from the corresponding framework region of the light chain variable region of the corresponding murine antibody comprising the amino acid sequence of SEQ ID NO: 140.

Most preferably, the humanized heavy chain variable domain comprises a modification to abrogate binding to Protein A comprising the substitution G65S or the substitution N82aS (Kabat numbering).

In particular the OX40 binding polypeptide comprises variable heavy chain domain and variable light chain domain pair encoded by SEQ ID NOs: 141/142, 278/280 and 279/281.

In one embodiment, the epitope binding region that binds a disease associated antigen binds to CD19. The epitope binding region comprises a heavy chain variable framework region that is the product of or derived from the human VH3 subclass, preferably human VH3-23, more preferably human IGHV3-23*04 (SEQ ID NO: 22) and most preferably comprises the amino acid sequence of SEQ ID NO: 296. The epitope binding region further comprises a light chain variable framework region that is the product of or derived from the human VK1 subclass, preferably human VK1-39, more preferably human IGKV1-39*01 (SEQ ID NO: 23) and most preferably comprises the amino acid sequence of SEQ ID NO: 297. In a preferred embodiment, the heavy chain variable domain comprises a modification to abrogate binding to Protein A comprising the substitution G65S or the substitution N82aS (Kabat numbering).

In particular the CD19 binding polypeptide comprises variable heavy chain domain and variable light chain domain pair encoded by SEQ ID NOs: 296/297.

In one embodiment, the epitope binding region that binds a disease associated antigen binds to CD20. The epitope binding region comprises a heavy chain variable framework region that is the product of or derived from the human VH3 subclass, preferably human VH3-23, more preferably human IGHV3-23*04 (SEQ ID NO: 22). The heavy chain variable framework region comprises at least one amino acid modification from the corresponding framework region of the heavy chain variable region of the corresponding murine antibody comprising the amino acid sequence of SEQ ID NO: 143. The epitope binding region further comprises a light chain variable framework region that is the product of or derived from the human VK1 subclass, preferably human VK1-39, more preferably human IGKV1-39*01 (SEQ ID NO: 23). The light chain variable framework region comprises at least one amino acid modification from the corresponding framework region of the light chain variable region of the corresponding murine antibody comprising the amino acid sequence of SEQ ID NO: 144.

Most preferably, the humanized heavy chain variable domain comprises a modification to abrogate binding to Protein A comprising the substitution G65S or the substitution N82aS (Kabat numbering).

In particular the EGFR binding polypeptide comprises variable heavy chain domain and variable light chain domain pair encoded by SEQ ID NOs: 143/144, 282/284, 283/285.

In one embodiment, the epitope binding region that binds a disease associated antigen binds to EGFR. The epitope binding region comprises a heavy chain variable framework region that is the product of or derived from the human VH3 subclass, preferably human VH3-23, more preferably human IGHV3-23*04 (SEQ ID NO: 22). The heavy chain variable framework region comprises at least one amino acid modification from the corresponding framework region of the heavy chain variable region of the corresponding murine antibody comprising the amino acid sequence of SEQ ID NO: 145. The epitope binding region further comprises a light chain variable framework region that is the product of or derived from the human VK1 subclass, preferably human VK1-39, more preferably human IGKV1-39*01 (SEQ ID NO: 23). The light chain variable framework region comprises at least one amino acid modification from the corresponding framework region of the light chain variable region of the corresponding murine antibody comprising the amino acid sequence of SEQ ID NO: 146.

Most preferably, the humanized heavy chain variable domain comprises a modification to abrogate binding to Protein A comprising the substitution G65S or the substitution N82aS (Kabat numbering).

In particular the CD20 binding polypeptide comprises variable heavy chain domain and variable light chain domain pair encoded by SEQ ID NOs: 145/146, 286/288, 287/289, 290/291, 292/294.

In one embodiment, the epitope binding region that binds a disease associated antigen binds to IgE. The epitope binding region comprises a heavy chain variable framework region that is the product of or derived from the human VH3 subclass, preferably human VH3-23, more preferably human IGHV3-23*04 (SEQ ID NO: 22). The heavy chain variable framework region comprises at least one amino acid modification from the corresponding framework region of the heavy chain variable region of the corresponding humanized antibody comprising the amino acid sequence of SEQ ID NO: 298 or the corresponding murine antibody comprising the amino acid sequence of SEQ ID NO: 304. The epitope binding region further comprises a light chain variable framework region that is the product of or derived from the human VK1 subclass, preferably human VK1-39, more preferably human IGKV1-39*01 (SEQ ID NO: 23). The light chain variable framework region comprises at least one amino acid modification from the corresponding framework region of the light chain variable region of the corresponding humanized antibody comprising the amino acid sequence of SEQ ID NO: 299 or the corresponding murine antibody comprising the amino acid sequence of SEQ ID NO: 305.

Most preferably, the heavy chain variable domain comprises a modification to abrogate binding to Protein A comprising the substitution G65S or the substitution N82aS (Kabat numbering).

In particular the IgE binding polypeptide comprises variable heavy chain domain and variable light chain domain pair encoded by SEQ ID NOs, 298/299, 300/302, 301/303, 304/305, 306/308, 307/309.

Anti-CD3 antibodies have been found to trigger toxicity by both direct and indirect mechanisms. Indirect mechanisms are mediated by the Fc region of the CD3 antibody which acts with the Fc receptor expressing immune cells and lead to transient T cell activation and cytokine release. Therefore in order to improve the safety of the hetero-dimeric immunoglobulins or fragment thereof as described herein, the immunoglobulin constant region of the first and/or second polypeptide has reduced or no binding for effector immune cells and/or complement C1q. Preferably, the immunoglobulin constant region is engineered to abrogate Fc receptor binding in the lower hinge region. More preferably the immunoglobulin constant region of the first and/or second polypeptide comprises the substitution(s) L234A and/or L235A (EU numbering). Most preferably, the immunoglobulin constant region of the first and/or second polypeptide comprises the substitutions L234A and L235A (EU numbering).

In another aspect, the disclosure of the present invention also describes a hetero-dimeric immunoglobulin or fragment thereof wherein the epitope binding region binds to the CD3 epsilon subunit of the CD3 protein complex and comprises a FAB having a FAB thermo-stability superior to the FAB thermo-stability of the OKT3 chimera comprising a heavy chain variable domain of amino acid sequence of SEQ ID NO: 25 and a light chain variable domain of amino acid sequence of SEQ ID NO: 26, as measured by Differential Scanning Calorimetry (DSC) as described in FIG. 9.

In further aspect, the present invention provides a hetero-dimeric immunoglobulin or fragment thereof as described herein wherein one epitope binding region binds to the CD3 epsilon subunit of the CD3 protein complex and the other epitope binding region that binds a disease associated antigen, binds HER2. The potency of such a hetero-dimeric immunoglobulin or fragment thereof to redirect T-cell killing can be measured in an in vitro assay using a flow cytometry method (RDL-FACS) or a colorimetric based method (RDL-MTS) on cell lines expressing HER2 such as JIMT-1, BT-474 and MDA-MB-231, as described in the Examples.

In one embodiment the hetero-dimeric immunoglobulin or fragment thereof that binds to CD3 epsilon and HER2 kills JIMT-1 cells with a potency of 21 pM or less. Alternatively, the hetero-dimeric immunoglobulin or fragment thereof also kills BT-474 cells with a potency of 2 pM or less. In addition, the hetero-dimeric immunoglobulin or fragment thereof also kills MDA-MB-231 cells with a potency of 0.2 nM or less. The cytotoxicity of all cell lines was measured in a RDL assay performed with human PBMCs at an effector:target cell ratio of 10:1 over 48 h. Furthermore, this hetero-dimeric immunoglobulin or fragment thereof shows a potent anti-tumour effect wherein tested in vivo in a JIMT-1/PBMC xenograft model. Preferably the hetero-dimeric immunoglobulin or fragment thereof kills JIMT-1 cells at 0.05 mg/kg in a JIMT-1 cell xenograft.

In a preferred embodiment, the present invention provides hetero-dimeric immunoglobulin or fragment thereof binding to:

i) the CD3 protein complex and HER2, wherein the first polypeptide has an amino acid sequence of SEQ ID NO: 159 and is assembled with a light chain of amino acid sequence of SEQ ID NO: 47 and binds CD3 epsilon, and wherein the second polypeptide has an amino acid sequence of SEQ ID NO: 160 and binds HER2;

ii) the CD3 protein complex and HER2, wherein the first polypeptide has an amino acid sequence of SEQ ID NO: 161 and is assembled with a cognate light chain of amino acid sequence of SEQ ID NO: 3 and binds HER2, and wherein the second polypeptide has an amino acid sequence of SEQ ID NO: 162 and binds CD3 epsilon;

iii) the CD3 protein complex and HER2, wherein the first polypeptide has an amino acid sequence of SEQ ID NO: 163 and is assembled with a light chain of amino acid sequence of SEQ ID NO: 47 and binds CD3 epsilon, and wherein the second polypeptide has an amino acid sequence of SEQ ID NO: 164 and binds HER2;

iv) the CD3 protein complex and HER2, wherein the first polypeptide has an amino acid sequence of SEQ ID NO: 165 and is assembled with a light chain of amino acid sequence of SEQ ID NO: 166 and binds CD3 epsilon, and wherein the second polypeptide has an amino acid sequence of SEQ ID NO: 167 and binds HER2;

v) the CD3 protein complex and HER2, wherein the first polypeptide has an amino acid sequence of SEQ ID NO: 168 and is assembled with a light chain of amino acid sequence of SEQ ID NO: 89 and binds CD3 epsilon, and wherein the second polypeptide has an amino acid sequence of SEQ ID NO: 167 and binds HER2;

vi) the CD3 protein complex and CD38, wherein the first polypeptide has an amino acid sequence of SEQ ID NO: 169 and is assembled with a cognate light chain of amino acid sequence of SEQ ID NO: 119 and binds CD38, and wherein the second polypeptide has an amino acid sequence of SEQ ID NO: 162 and binds CD3 epsilon;

vii) the CD3 protein complex and CD38, wherein the first polypeptide has an amino acid sequence of SEQ ID NO: 170 and is assembled with a cognate light chain of amino acid sequence of SEQ ID NO: 138 and binds CD38, and wherein the second polypeptide has an amino acid sequence of SEQ ID NO: 171 and binds CD3 epsilon;

viii) the CD3 protein complex and CD38, wherein the first polypeptide has an amino acid sequence of SEQ ID NO: 176 and is assembled with a cognate light chain of amino acid sequence of SEQ ID NO: 119 and binds CD38, and wherein the second polypeptide has an amino acid sequence of SEQ ID NO: 177 and binds CD3 epsilon;

ix) the CD3 protein complex and CD38, wherein the first polypeptide has an amino acid sequence of SEQ ID NO: 178 and is assembled with a cognate light chain of amino acid sequence of SEQ ID NO: 128 and binds CD38, and wherein the second polypeptide has an amino acid sequence of SEQ ID NO: 179 and binds CD3 epsilon;

x) the CD3 protein complex and OX40 wherein the first polypeptide has an amino acid sequence of SEQ ID NO: 172 and is assembled with a cognate light chain of amino acid sequence of SEQ ID NO: 173 and binds OX40, and wherein the second polypeptide has an amino acid sequence of SEQ ID NO: 162 and binds CD3 epsilon;

xi) the CD3 protein complex and EGFR wherein the first polypeptide has an amino acid sequence of SEQ ID NO: 174 and is assembled with a cognate light chain of amino acid sequence of SEQ ID NO: 175 and binds EGFR, and wherein the second polypeptide has an amino acid sequence of SEQ ID NO: 171 and binds CD3 epsilon;

xii) the CD3 protein complex and CD20, wherein the first polypeptide has an amino acid sequence of SEQ ID NO: 180 and is assembled with a cognate light chain of amino acid sequence of SEQ ID NO: 181 and binds CD20, and wherein the second polypeptide has an amino acid sequence of SEQ ID NO: 177 and binds CD3 epsilon.

In a further embodiment, the present invention provides hetero-dimeric immunoglobulin or fragment thereof binding to: the CD3 protein complex and HER2, wherein the first polypeptide has an amino acid sequence of SEQ ID NO: 310 and is assembled with a light chain of amino acid sequence of SEQ ID NO: 3 and binds HER2, and wherein the second polypeptide has an amino acid sequence of SEQ ID NO: 311 and binds CD3 epsilon; the CD3 protein complex and CD38, wherein the first polypeptide has an amino acid sequence of SEQ ID NO: 312 and is assembled with a light chain of amino acid sequence of SEQ ID NO: 132 and binds CD38, and wherein the second polypeptide has an amino acid sequence of SEQ ID NO: 311 and binds CD3 epsilon; the CD3 protein complex and CD38, wherein the first polypeptide has an amino acid sequence of SEQ ID NO: 313 and is assembled with a light chain of amino acid sequence of SEQ ID NO: 138 and binds CD38, and wherein the second polypeptide has an amino acid sequence of SEQ ID NO: 311 and binds CD3 epsilon; the CD3 protein complex and OX40, wherein the first polypeptide has an amino acid sequence of SEQ ID NO: 314 and is assembled with a light chain of amino acid sequence of SEQ ID NO: 315 and binds OX40, and wherein the second polypeptide has an amino acid sequence of SEQ ID NO: 311 and binds CD3 epsilon; the CD3 protein complex and OX40, wherein the first polypeptide has an amino acid sequence of SEQ ID NO: 316 and is assembled with a light chain of amino acid sequence of SEQ ID NO: 317 and binds OX40, and wherein the second polypeptide has an amino acid sequence of SEQ ID NO: 311 and binds CD3 epsilon; the CD3 protein complex and CD20, wherein the first polypeptide has an amino acid sequence of SEQ ID NO: 318 and is assembled with a light chain of amino acid sequence of SEQ ID NO: 319 and binds CD20, and wherein the second polypeptide has an amino acid sequence of SEQ ID NO: 311 and binds CD3 epsilon; the CD3 protein complex and CD20, wherein the first polypeptide has an amino acid sequence of SEQ ID NO: 320 and is assembled with a light chain of amino acid sequence of SEQ ID NO: 321 and binds CD20, and wherein the second polypeptide has an amino acid sequence of SEQ ID NO: 311 and binds CD3 epsilon; the CD3 protein complex and EGFR, wherein the first polypeptide has an amino acid sequence of SEQ ID NO: 322 and is assembled with a light chain of amino acid sequence of SEQ ID NO: 323 and binds EGFR, and wherein the second polypeptide has an amino acid sequence of SEQ ID NO: 311 and binds CD3 epsilon; the CD3 protein complex and EGFR, wherein the first polypeptide has an amino acid sequence of SEQ ID NO: 324 and is assembled with a light chain of amino acid sequence of SEQ ID NO: 325 and binds EGFR, and wherein the second polypeptide has an amino acid sequence of SEQ ID NO: 311 and binds CD3 epsilon; the CD3 protein complex and EGFR, wherein the first polypeptide has an amino acid sequence of SEQ ID NO: 326 and is assembled with a light chain of amino acid sequence of SEQ ID NO: 327 and binds EGFR, and wherein the second polypeptide has an amino acid sequence of SEQ ID NO: 311 and binds CD3 epsilon; the CD3 protein complex and EGFR, wherein the first polypeptide has an amino acid sequence of SEQ ID NO: 328 and is assembled with a light chain of amino acid sequence of SEQ ID NO: 329 and binds EGFR, and wherein the second polypeptide has an amino acid sequence of SEQ ID NO: 311 and binds CD3 epsilon; the CD3 protein complex and CD19, wherein the first polypeptide has an amino acid sequence of SEQ ID NO: 330 and is assembled with a light chain of amino acid sequence of SEQ ID NO: 331 and binds CD19, and wherein the second polypeptide has an amino acid sequence of SEQ ID NO: 311 and binds CD3 epsilon; the CD3 protein complex and IgE, wherein the first polypeptide has an amino acid sequence of SEQ ID NO: 332 and is assembled with a light chain of amino acid sequence of SEQ ID NO: 333 and binds IgE, and wherein the second polypeptide has an amino acid sequence of SEQ ID NO: 311 and binds CD3 epsilon; the CD3 protein complex and IgE, wherein the first polypeptide has an amino acid sequence of SEQ ID NO: 334 and is assembled with a light chain of amino acid sequence of SEQ ID NO: 335 and binds IgE, and wherein the second polypeptide has an amino acid sequence of SEQ ID NO: 311 and binds CD3 epsilon; the CD3 protein complex and IgE, wherein the first polypeptide has an amino acid sequence of SEQ ID NO: 336 and is assembled with a light chain of amino acid sequence of SEQ ID NO: 337 and binds IgE, and wherein the second polypeptide has an amino acid sequence of SEQ ID NO: 311 and binds CD3 epsilon; the CD3 protein complex and IgE, wherein the first polypeptide has an amino acid sequence of SEQ ID NO: 338 and is assembled with a light chain of amino acid sequence of SEQ ID NO: 339 and binds IgE, and wherein the second polypeptide has an amino acid sequence of SEQ ID NO: 311 and binds CD3 epsilon; the CD3 protein complex and OX40, wherein the first polypeptide has an amino acid sequence of SEQ ID NO: 340 and is assembled with a light chain of amino acid sequence of SEQ ID NO: 173 and binds OX40, and wherein the second polypeptide has an amino acid sequence of SEQ ID NO: 311 and binds CD3 epsilon; the CD3 protein complex and CD20, wherein the first polypeptide has an amino acid sequence of SEQ ID NO: 341 and is assembled with a light chain of amino acid sequence of SEQ ID NO: 181 and binds CD20, and wherein the second polypeptide has an amino acid sequence of SEQ ID NO: 311 and binds CD3 epsilon; the CD3 protein complex and EGFR, wherein the first polypeptide has an amino acid sequence of SEQ ID NO: 342 and is assembled with a light chain of amino acid sequence of SEQ ID NO: 175 and binds EGFR, and wherein the second polypeptide has an amino acid sequence of SEQ ID NO: 311 and binds CD3 epsilon; the CD3 protein complex and EGFR, wherein the first polypeptide has an amino acid sequence of SEQ ID NO: 343 and is assembled with a light chain of amino acid sequence of SEQ ID NO: 344 and binds EGFR, and wherein the second polypeptide has an amino acid sequence of SEQ ID NO: 311 and binds CD3 epsilon; the CD3 protein complex and IgE, wherein the first polypeptide has an amino acid sequence of SEQ ID NO: 345 and is assembled with a light chain of amino acid sequence of SEQ ID NO: 346 and binds IgE, and wherein the second polypeptide has an amino acid sequence of SEQ ID NO: 311 and binds CD3 epsilon; the CD3 protein complex and IgE, wherein the first polypeptide has an amino acid sequence of SEQ ID NO: 347 and is assembled with a light chain of amino acid sequence of SEQ ID NO: 348 and binds IgE, and wherein the second polypeptide has an amino acid sequence of SEQ ID NO: 311 and binds CD3 epsilon.

In accordance with a further aspect of the present invention the hetero-dimeric immunoglobulin or fragment thereof wherein said CD3 binding polypeptide comprises at least one or a combination of a heavy and light chain variable regions selected from the group: SEQ ID NOs: 48/51, 49/51, 101/105, 103/106, 104/106, 358/51 and wherein said disease associated antigen binding polypeptide comprises at least one or a combination of a heavy and light chain variable regions selected from the group: SEQ ID NOs: 20/21, 116/117, 129/130, 133/134, 135/136, 139/140, 141/142, 278/280, 279/281, 143/144, 282/284, 283/285, 296/297, 145/146, 286/288, 287/289, 290/291, 292/294, 293/295, 298/299, 300/302, 301/303, 304/305, 306/308, 307/309.

As discussed above for bispecific antibody generation, there is a need to efficiently produce anti-human CD3 based heavy chain hetero-dimers free of anti-human CD3 homo-dimers wherein the secreted bispecific antibody product is readily isolated from the cell culture supernatant from a recombinant mammalian host cell line. To this effect, a Protein A based differential purification technique can be used to isolate hetero-dimeric immunoglobulins or fragments thereof encompassing the variable domain subclass of VH3, wherein the Protein A binding site in at least one but preferably both VH3 based epitope binding regions is abrogated. Therefore, in another aspect, the present invention provides an in vitro method for the production of a hetero-dimeric immunoglobulin or fragment thereof as described herein, comprising the following steps: ia) preparing a DNA vector encoding a heavy chain of the first polypeptide and a DNA vector encoding a heavy chain of the second polypeptide wherein one or both DNA vectors or a third DNA vector optionally encode a common light chain or a light chain that assembles with a heavy chain of the first or second polypeptide; or ib) preparing one DNA vector encoding heavy chains of the first and second polypeptides wherein the DNA vector optionally encodes a common light chain or a light chain that assembles with a heavy chain of the first or second polypeptide; and wherein said DNA vectors are suitable for transient or stable expression in a mammalian host cell; ii) transfecting or co-transfecting the DNA vector(s) from (i) in a mammalian host cell line; iii) culturing the transfected cell line or stably selected clone therefrom and harvesting the cell culture supernatant; iv) contacting the cell culture supernatant on a Protein A affinity chromatography resin; v) eluting and collecting the hetero-dimeric immunoglobulin of interest.

Preferably the hetero-dimeric immunoglobulin or fragment thereof found in the purified material from step (v) is at least 95% pure. More preferably the hetero-dimeric immunoglobulin or fragment thereof found in the purified material from step (v) is at least 96% pure. Even more preferably the hetero-dimeric immunoglobulin or fragment thereof found in the purified material from step (v) is at least 97%. Purity of the hetero-dimeric immunoglobulin or fragment thereof found in the purified material can be measured by capillary electrophoresis.

In accordance with a further aspect of the present invention there is provided a polypeptide comprising at least one CDRs from the groups: SEQ ID NOs: 224-229, 230-235 and 352-357; or combinations of heavy chain variable domain and light chain variable domain pairs selected from the group: SEQ ID NOs: 122/123, 124/125, 129/130, 135/136, 133/134 104/106; and heavy and light chain sequence pair selected from the group: 126/127 or 128, 131/132, 137/138, 359/360.

BRIEF DESCRIPTION OF THE FIGURES

FIG. 2A-F: Schematic diagrams illustrating the problems faced when purifying hetero-dimers of heavy chains encompassing one or more VH3 domains using differential protein A chromatography. Examples of solutions based on mutating the Protein A binding site within at least one VH3 domain of the hetero-dimer are shown. FIG. 2A: Problem faced when the hetero-dimer of heavy chains encompasses a VH3 domain within the heavy chain that does not bind Protein A in its Fc region. FIG. 2B: Solution to the purification problem described in FIG. 2A, the heavy chain of the hetero-dimer that does not bind Protein A in its Fc region encompasses a VH3 domain which has been mutated to abrogate its Protein A binding site. FIG. 2C: Alternative solution to the problem described in FIG. 2A, the hetero-dimer encompasses only one VH3 domain and the hetero-dimer is engineered to have its VH3 domain located on the heavy chain that binds Protein A in its Fc region (VH3 domain relocation strategy as a solution). FIG. 2D: Problem faced when both heavy chains of the hetero-dimer encompass a VH3 domain. FIG. 2E: Solution to the purification problem described in FIG. 2D, the heavy chain of the hetero-dimer that does not bind Protein A in its Fc region encompasses a VH3 domain which has been mutated to abrogate its Protein A binding site. FIG. 2F: Alternative solution to the purification problem described in FIG. 2D, each VH3 domain has its Protein A binding site abrogated. Boxed species indicated that these species co-elute during the differential Protein A chromatography process. pH values A and B differ by about one pH unit and allow efficient separation of the species that binds Protein A. Typically pH values for pH A and pH B are 4 and 3, respectively. Legend for all figures: [(A+)] means a functional Protein A binding site and [(A−)] means a nonfunctional Protein A binding site.

FIG. 4A: Anti-HER2 FAB-Fc 133 (HiTrap™ MabSelect SuRe™ Protein A column). FIG. 4B: Anti-HER2 scFv-Fc 133 (HiTrap™ MabSelect SuRe™ Protein A column). FIG. 4C: Anti-HER2 FAB (HiTrap™ MabSelect SuRe™ Protein A column and HiTrap™ MabSelect™ Protein A column).

FIG. 5: Representative amino acid sequences for each of the seven known human VH framework subclasses. Sequences were aligned according to the Kabat numbering, Positions in the human VH3-23 framework subclass that interact with the domain D of Protein A are shown in bold. The representative amino acid sequences for each of the seven known human VH framework subclasses are represented by the following SEQ NOs: Human IGHV1-3 (SEQ ID NO: 361), Human IGHV2-26 (SEQ ID NO: 362), Human IGHV3-23 (SEQ ID NO: 363), Human IGHV4-28 (SEQ ID NO: 364), Human IGHV5-51 (SEQ ID NO: 365), Human IGHV6-1 (SEQ ID NO: 366), Human IGHV7-4-1 (SEQ ID NO: 367).

FIG. 6A: Anti-HER2 FAB. FIG. 6B: Anti-HER2 FAB T57A. FIG. 6C: Anti-HER2 FAB T57E. FIG. 6D: Anti-HER2 FAB G65S. FIG. 6E: Anti-HER2 FAB R66Q. FIG. 6F: Anti-HER2 FAB T68V. FIG. 6G: Anti-HER2 FAB Q81E. FIG. 6H: Anti-HER2 FAB N82aS. FIG. 6I: Anti-HER2 FAB R19G/T57A/Y59A.

FIG. 8A: Anti-HER2 scFv(G65S)-Fc 133. FIG. 8B: Anti-HER2 scFv(N82aS)-Fc 133. FIG. 8C: Anti-HER2 FAB(G65S)-Fc 133. FIG. 8D: Anti-HER2 FAB(N82aS)-Fc 133.

FIG. 9A-F: These figures all relate to OKT3 humanization on stable human frameworks. FIG. 9A-C: Summary of humanized candidates formatted as human IgG1 antibodies. HPB-ALL staining relative to the chimeric OKT3 antibody: (−) indicates no binding, (+) weaker binding, (++) moderate binding and (+++) similar binding. FIG. 9D: DSC profiles of selected antibodies of candidates. FIG. 9E: Summary of humanized candidates formatted as scFv-Fc fusions. HPB-ALL staining relative to the chimeric OKT3 antibody: (−) indicates no binding, (+) weaker binding, (++) moderate binding and (+++) similar binding. FIG. 9F: DSC profiles of selected scFv-Fc candidates.

FIG. 10A-B: These figures all relate to SP34 humanization on stable human frameworks. FIG. 10A: Summary of humanized candidates formatted as human IgG1 antibodies. FIG. 10B: Summary of humanized candidates formatted as scFv-Fc fusion proteins (Fc of human IgG1 isotype). SPR data relative to the chimeric SP34 antibody for human and cynomolgus monkey CD3 epsilon 1-26_Fc fusion proteins: (−) indicates no binding, (+) weaker binding, (++) moderate binding, strong but not similar binding (+++), and (++++) similar binding.

FIG. 11A-J: These figures all relate to anti-human CD38 antibodies. FIG. 11A: Antibody-antigen interaction measured by SPR between the chimeric HB-7 antibody and the human CD38 antigen. A CM5 sensor chip was covalently coupled with protein G and 200 RUs of chimeric HB-7 antibody were captured. Human CD38 protein (human CD38 extracellular domain with a poly-histidine tag) was injected at 125, 31, 7.8, 3.9, 1.9, 1 and 0.5 nM at a flow rate of 30 µl/min in HBS-P. FIG. 11B: Antibody-antigen interaction measured by SPR between the humanized HB-7 best-fit antibody and the human CD38 antigen. A CM5 sensor chip was covalently coupled with protein G and 200 RUs of humanized HB-7 best-fit antibody were captured. Human CD38 protein (human CD38 extracellular domain with a poly-histidine tag) was injected at 50, 25, 12.5, 6.25 and 0.39 nM at a flow rate of 30 µl/min in HBS-P. FIG. 11C: Antibody-antigen interaction measured by SPR between the humanized 9G7 best-fit antibody and the human CD38 antigen. A CM5 sensor chip was covalently coupled with protein G and 200 RUs of humanized 9G7 best-fit antibody were captured. Human CD38 protein (human CD38 extracellular domain with a poly-histidine tag) was injected at 25, 12.5, 6.25, 3.12, 1.56, 0.78, 0.39, 0.19, and 0.1 nM at a flow rate of 30 µl/min in HBS-P. FIG. 11D: Antibody-antigen interaction measured by SPR between the humanized 9G7 best-framework antibody and the human CD38 antigen. A CM5 sensor chip was covalently coupled with protein G and 200 RUs of humanized 9G7 best-framework antibody were captured. Human CD38 protein (human CD38 extracellular domain with a poly-histidine tag) was injected at 50, 25, 12.5, 6.25, 3.12, 1.56, 0.78, 0.39, 0.19, and 0.1 nM at a flow rate of 30 µl/min in HBS-P. FIG. 11E: Antibody-antigen interaction measured by SPR between the human 767 antibody and the human CD38 antigen. A CM5 sensor chip was covalently coupled with protein G and 200 RUs of human 767 antibody were captured. Human CD38 protein (human CD38 extracellular domain with a poly-histidine tag) was injected at 500, 250, 125, 62.5, 31.25, and 15.6 nM at a flow rate of 30 µl/min in HBS-P. Affinity was obtained from a plot of the equilibrium response (Req) vs. analyte concentration (C) according to the following equation: Req=KA*C*Rmax/(KA*C*n+1), concentration at 50% saturation is KD. All SPR data are expressed as number of response units (abbreviated RU; Y axis) vs. time (X axis). FIG. 11F: DSC profiles of chimeric HB-7 and humanized HB-7 best-fit antibodies. FIG. 11G: DSC profiles of chimeric 9G7 and humanized 9G7 best-fit antibodies. FIG. 11H: DSC profiles of humanized 9G7 best-framework antibody. FIG. 11I: DSC profiles of human clone 767 antibody. FIG. 11J: summary table for the 9G7 humanized antibodies.

FIG. 12A: BEAT HER2/CD3-1 (format A) and BEAT HER2/CD3-2 (format B) antibodies. FIG. 12B: BEAT HER2/CD3-3 (format C) and BEAT HER2/CD3(SP34) (format D) antibodies. FIG. 12C: BEAT HER2/CD3(SP34-Kappa1) (format E) antibody. Legend: [(A+)] means functional Protein A binding site. [(A−)] means nonfunctional Protein A binding site.

FIG. 16A: Antibody-antigen interaction measured by SPR between the BEAT HER2/CD3-1 antibody and the human CD3 epsilon antigen. A CM5 sensor chip was covalently coupled with 7400 RUs of the human CD3 gamma-epsilon-Fc fusion protein. BEAT HER2/CD3-1 antibody was injected at 5000, 2500, 1250, 625, 312.5 and 156.25 nM at a flow rate of 10 µl/min in HBS-P. Data are expressed as number of response units (abbreviated RU; Y axis) vs. time (X axis). Affinity was obtained from a plot of the equilibrium response (Req) vs. analyte concentration (C) according to the following equation: Req=KA*C*Rmax/(KA*C*n+1), concentration at 50% saturation is KD. FIG. 16B: Antibody-antigen interaction measured by SPR between the BEAT HER2/CD3-1 antibody and the human HER2 antigen. A CM5 sensor chip was covalently coupled protein G and 150 RUs of BEAT HER2/CD3-1 antibody were captured. HER2-his was injected at 1000, 333, 111, 37, 12, 4.1, 1.4, 0.5 and 0.15 nM at a flow rate of 30 µl/min in HBS-P. Data are expressed as number of response units (abbreviated RU; Y axis) vs. time (X axis).

FIG. 17A: BEAT HER2/CD3-1 and BEAT HER2/CD3-2 antibodies, target cells: BT-474. FIG. 17B: BEAT HER2/CD3-1 and BEAT HER2/CD3-2 antibodies, target cells: JIMT-1. FIG. 17C: BEAT HER2/CD3-1 and BEAT HER2/CD3-2 antibodies, target cells: MDA-MB-231. FIG. 17D: BEAT HER2/CD3(SP34) antibody, target cells: NCI-N87. FIG. 17E: BEAT HER2/CD3(SP34) antibody, target cells: HT-1080. FIG. 17F: BEAT HER2/CD3(SP34-Kappa1) antibody, target cells: NCI-N87. FIG. 17G: BEAT HER2/CD3 (SP34-Kappa1) antibody, target cells: HT-1080.

FIG. 18A: Human PBMC's do not interfere with tumor growth. FIG. 18B-C: Tumor volumes (mm$^3$) for BEAT HER2/CD3-1 treated and non-treated mice, four human PBMC donors, cohorts of five mice.

FIG. 20B: BEAT CD38-HB7bestfit/CD3 antibody DSC profile.

DETAILED DESCRIPTION OF THE INVENTION

Figure 1:
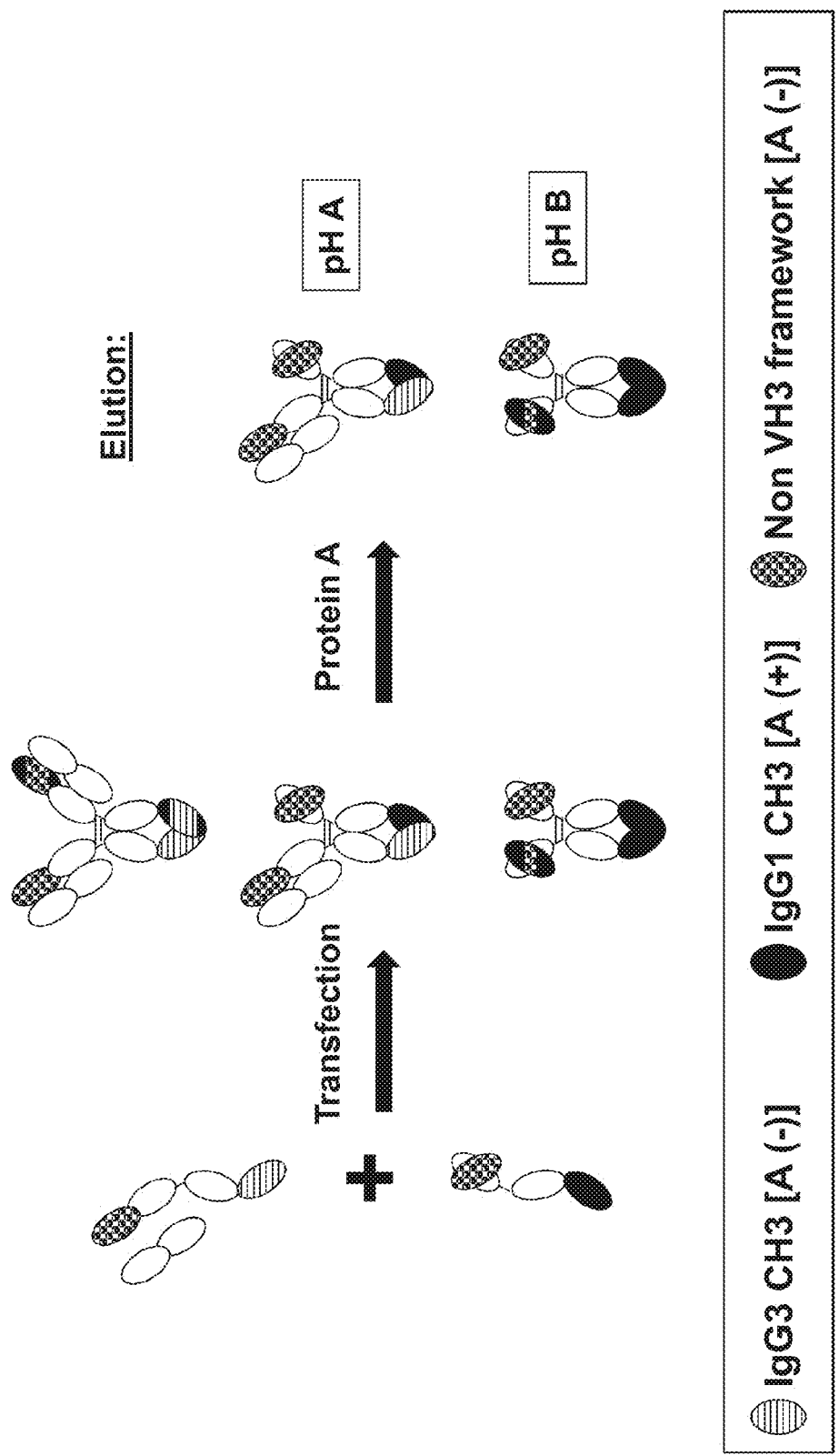
FIG. 1: Schematic diagram of the preferred differential affinity purification technique using Protein A. None of the heavy chains encompass a VH3 based antigen binding site. Legend: [(A+)] means a functional Protein A binding site and [(A−)] means a nonfunctional Protein A binding site. pH of elution is indicated.

The present invention relates generally to novel hetero-dimeric immunoglobulins that bind to the CD3 protein complex and a disease associated antigen. Furthermore, these hetero-dimeric immunoglobulins have reduced or eliminated binding to protein A and therefore can be purified to a very high degree of purity using affinity chromatography.

For the purposes of interpreting this specification, the following definitions will apply and whenever appropriate, terms used in the singular will also include the plural and vice versa. It is to be understood that the terminology used herein is for the purpose of describing particular embodiments only and is not intended to be limiting.

The terms "polypeptide" and "protein" refer to a polymer of amino acid residues wherein amino acids are combined via peptide bonds to form a chain of amino acids that have been linked together via dehydration synthesis. Polypeptides and proteins can be synthesized through chemical synthesis or recombinant expression and are not limited to a minimum amino acid length.

In accordance with the invention, the group of polypeptides comprises "proteins" as long as the proteins consist of a single polypeptide chain. Polypeptides may further form multimers such as dimers, trimers and higher oligomers, i.e. consisting of more than one polypeptide molecule. Polypeptide molecules forming such dimers, trimers etc. may be identical or non-identical. The corresponding higher order structures of such multimers are, consequently, termed homo- or hetero-dimers, homo- or hetero-trimers etc. An example for a hetero-multimer is an antibody molecule, which, in its naturally occurring form, consists of two identical light polypeptide chains and two identical heavy polypeptide chains. The terms "polypeptide" and "protein" also refer to naturally modified polypeptides/proteins wherein the modification is effected e.g. by post-translational modifications like glycosylation, acetylation, phosphorylation and the like. Such modifications are well known in the art. Furthermore, for purposes of the present invention, a "polypeptide" refers to a protein which includes modifications, such as deletions, additions and substitutions (which can be conservative in nature) to the native sequence. These modifications may be deliberate, as through site-directed mutagenesis, or may be accidental, such as through mutations of hosts which produce the proteins or errors due to PCR amplification.

The term "CD3 complex" as used herein refers to the protein complex known as the CD3 (cluster of differentiation 3) T-cell co-receptor (Wucherpfennig K W et al., (2010) Cold Spring Harb Perspect Biol, 2(4): a005140). The CD3 protein complex is composed of four distinct chains. In mammals, the complex contains a CD3γ chain, a CD3δ chain, and two CD3ε chains. These chains associate with a molecule known as the T-cell receptor (TCR) and the ζ-chain to generate an activation signal in T lymphocytes (van der Merwe P A & Dushek O (2011) Nat Rev Immunol, 11(1): 47-55). The TCR, ζ-chain, and CD3 molecules together comprise the TCR complex. The CD3γ, CD3δ, and CD3ε chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signalling capacity of the TCR. Since CD3 is required for T-cell activation, drugs (often monoclonal antibodies) that target CD3 have and are being investigated as immunosuppressant therapies.

The term "disease associated antigen" as used herein refers to molecules that are involved in a disease process. Examples of disease associated antigens are found in a broad range of therapeutic areas such as inflammation, cancer and autoimmune diseases. In oncology, disease associated antigens are molecules that can broadly be used for the screening and/or monitoring and/or therapeutic targeting of cancers within a patient population, for example EpCAM antigen in prostate cancer. Tumour antigens can be produced directly by the tumour or by non-tumour cells as a response to the presence of a tumour and preferred tumour antigens are cell-surface molecules. Inflammatory disease associated antigens are known, which include but are not limited to, pro-inflammatory cytokines such as TNF-α and IL-1. Autoimmune disease associated antigens are also known; examples of these include but are not limited to antibodies against double-stranded DNA in systemic lupus erythematosus and amyloid beta peptide in Alzheimers disease.

The term "immunoglobulin" as referred to herein can be used interchangeably with the term "antibody". Immunoglobulin includes full-length antibodies and any antigen binding fragment or single chains thereof. Immunoglobulins can be homo-dimeric or hetero-dimeric. Immunoglobulins and specifically naturally occurring antibodies are glycoproteins which exist as one or more copies of a Y-shaped unit, composed of four polypeptide chains. Each "Y" shape contains two identical copies of a heavy (H) chain and two identical copies of a light (L) chain, named as such by their relative molecular weights. Each light chain pairs with a heavy chain and each heavy chain pairs with another heavy chain. Covalent interchain disulfide bonds and non-covalent interactions link the chains together. Immunoglobulins and specifically naturally occurring antibodies contain variable regions, which are the two copies of the antigen binding site. Papain, a proteolytic enzyme splits the "Y" shape into three separate molecules, two so called "Fab" or "FAB" fragments (Fab=fragment antigen binding) and one so called "Fe" fragment or "Fc region" (Fc=fragment crystallizable). A Fab fragment consists of the entire light chain and part of the heavy chain. The heavy chain contains one variable region (VH) and either three or four constant regions (CH1, CH2, CH3 and CH4, depending on the antibody class or isotype). The region between the CH1 and CH2 regions is called the hinge region and permits flexibility between the two Fab arms of the Y-shaped antibody molecule, allowing them to open and close to accommodate binding to two antigenic determinants separated by a fixed distance. The "hinge region" as referred to herein is a sequence region of 6-62 amino acids in length, only present in IgA, IgD and IgG, which encompasses the cysteine residues that bridge the two heavy chains. The heavy chains of IgA, IgD and IgG each have four regions, i.e. one variable region (VH) and three constant regions (CH1-3). IgE and IgM have one variable and four constant regions (CH1-4) on the heavy chain. The constant regions of the immunoglobulins may mediate the binding to host tissues or factors, including various cells of the immune system (e.g., effector cells) and the first component (C1q) of the complement system classical pathway. Each light chain is usually linked to a heavy chain by one covalent disulfide bond. Each light chain contains one variable region (VL) and one light chain constant region.

The light chain constant region is a kappa light chain constant region designated herein as IGKC or is a lambda light chain constant region designated herein as IGLC. IGKC is used herein equivalently to CK or Cκ and has the same meaning. IGLC is used herein equivalently to CA or CL and has the same meaning. The term "an IGLC region" as used herein refer to all lambda light chain constant regions e.g. to all lambda light chain constant regions selected from the group consisting of IGLC1, IGLC2, IGLC3, IGLC6 and IGLC7. The VH and VL regions can be further subdivided into regions of hypervariability, termed complementarity determining regions (CDR), interspersed with regions that are more conserved, termed framework regions (FR or FW). Each VH and VL is composed of three CDRs and four FRs, arranged from amino-terminus to carboxy-terminus in the following order: FR1, CDR1, FR2, CDR2, FR3, CDR3, FR4. The variable regions of the heavy and light chains contain an epitope-binding region that interacts with an antigen. Engineered immunoglobulins can encompass different epitope binding region formats such as scFv, FAB or dAb fragments. These fragments are usually assembled in an antibody-like structure by genetic fusion to a IgG Fc region. Engineered immunoglobulins can be constructed as homo or hetero-dimers with or without the use of hetero-dimerization enhancing techniques, and can have mono- or bispecific binding properties.

The term "full length antibody" as used herein includes the structure that constitutes the natural biological form of an antibody, including variable and constant regions. For example, in most mammals, including humans and mice, the full length antibody of the IgG class is a tetramer and consists of two identical pairs of two immunoglobulin chains, each pair having one light and one heavy chain, each light chain comprising immunoglobulin regions VL and a light chain constant region, and each heavy chain comprising immunoglobulin regions VH, CH1 (Cγ1), CH2 (Cγ2), CH3 (Cγ3) and CH4 (Cγ4), depending on the antibody class or isotype). In some mammals, for example in camels and llamas, IgG antibodies may consist of only two heavy chains, each heavy chain comprising a variable region attached to the Fc region.

Antibodies are grouped into classes, also referred to as isotypes, as determined genetically by the constant region. Human constant light chains are classified as kappa (CK) and lambda (Cλ) light chains. Heavy chains are classified as mu (μ), delta (δ), gamma (γ), alpha (α), or epsilon (ε) and define the antibody's isotype as IgM, IgD, IgG, IgA and IgE, respectively. Thus, "isotype" as used herein is meant any of the classes and/or subclasses of immunoglobulins defined by the chemical and antigenic characteristics of their constant regions. The known human immunoglobulin isotypes are IGHG1 (IgG1), IGHG2 (IgG2), IGHG3 (IgG3), IGHG4 (IgG4), IGHA1 (IgA1), IGHA2 (IgA2), IGHM (IgM), IGHD (IgD) and IGHE (IgE). The so-called human immunoglobulin pseudo-gamma IGHGP gene represents an additional human immunoglobulin heavy constant region gene which has been sequenced but does not encode a protein due to an altered switch region (Bensmana M et al., (1988) Nucleic Acids Res, 16(7): 3108). In spite of having an altered switch region, the human immunoglobulin pseudo-gamma IGHGP gene has open reading frames for all heavy constant regions (CH1-CH3) and hinge. All open reading frames for its heavy constant regions encode protein regions which align well with all human immunoglobulin constant regions with the predicted structural features. This additional pseudo-gamma isotype is referred herein as IgGP or IGHGP. Other pseudo immunoglobulin genes have been reported such as the human immunoglobulin heavy constant region epsilon P1 and P2 pseudo-genes (IGHEP1 and IGHEP2). The IgG class is the most commonly used for therapeutic purposes. In humans this class comprises sub-classes IgG1, IgG2, IgG3 and IgG4. In mice this class comprises subclasses IgG1, IgG2a, IgG2b. IgG2c and IgG3.

The term "Immunoglobulin fragments" as used herein include, but is not limited to, (i) a region including for example a CH1, a CH2 or a CH3 region, (ii) the Fab fragment consisting of VL, VH, CL or CK and CH1 regions, including Fab' and Fab'-SH, (ii) the Fd fragment consisting of the VH and CH1 regions, (iii) the dAb fragment (Ward E S et al., (1989) Nature, 341(6242): 544-6) which consists of a single variable region (iv) F(ab')$_2$ fragments, a bivalent fragment comprising two linked Fab fragments (v) single chain Fv fragments (scFv), wherein a VH region and a VL region are linked by a peptide linker which allows the two regions to associate to form an antigen binding site (Bird R E et al., (1988) Science, 242(4877): 423-6; Huston J S et al., (1988) Proc Natl Acad Sci USA, 85(16): 5879-83), (vi) "diabodies" or "triabodies", multivalent or multispecific fragments constructed by gene fusion (Holliger P et al., (1993) Proc Natl Acad Sci USA, 90(14): 6444-8; Tomlinson I & Holliger P, (2000) Methods Enzymol, 326:461-79), (vii) scFv, diabody or region antibody fused to an Fc region and (viii) scFv fused to the same or a different antibody.

The term "variable region" refers to the regions or domains that mediates antigen-binding and defines specificity of a particular antibody for a particular antigen. In naturally occurring antibodies, the antigen-binding site consists of two variable regions that define specificity: one located in the heavy chain, referred herein as heavy chain variable region (VH) and the other located in the light chain, referred herein as light chain variable region (VL). In humans, the heavy chain variable region (VH) can be divided into seven subgroups or subclasses: VH1, VH2, VH3, VH4, VH5, VH6 and VH7. In some cases, specificity may exclusively reside in only one of the two regions as in single-domain antibodies from heavy-chain antibodies found in camelids. The V regions are usually about 110 amino acids long and consist of relatively invariant stretches of amino acid sequence called framework regions (FRs or "non-CDR regions") of 15-30 amino acids separated by shorter regions of extreme variability called "hypervariable regions" that are 7-17 amino acids long. The variable domains of native heavy and light chains comprise four FRs, largely adopting a beta-sheet configuration, connected by three hypervariable regions, which form loops. The hypervariable regions in each chain are held together in close proximity by FRs and, with the hypervariable regions from the other chain, contribute to the formation of the antigen binding site of antibodies (see Kabat E A et al., supra.). The term "hypervariable region" as used herein refers to the amino acid residues of an antibody which are responsible for antigen binding. The hypervariable region generally comprises amino acid residues from a "complementary determining region" or "CDR", the latter being of highest sequence variability and/or involved in antigen recognition. For all variable regions numbering is according to Kabat (Kabat E A et al., supra.).

A number of CDR definitions are in use and are encompassed herein. The Kabat definition is based on sequence variability and is the most commonly used (Kabat E A el al., supra.). Chothia refers instead to the location of the structural loops (Chothia & Lesk J. (1987) Mol Biol, 196: 901-917). The AbM definition is a compromise between the Kabat and the Chothia definitions and is used by Oxford Molecular's AbM antibody modelling software (Martin A C R et al., (1989) Proc Natl Acad Sci USA 86:9268-9272; Martin A C R et al., (1991) Methods Enzymol, 203: 121-153; Pedersen J T et al., (1992) Immunomethods, 1: 126-136; Rees A R et al., (1996) In Sternberg M. J. E. (ed.), Protein Structure Prediction. Oxford University Press, Oxford, 141-172). The contact definition has been recently introduced (MacCallum R M et al., (1996) J Mol Biol, 262: 732-745) and is based on an analysis of the available complex structures available in the Protein Databank. The definition of the CDR by IMGT®, the international ImMunoGeneTics information system is based on the IMGT numbering for all immunoglobulin and T cell receptor V-REGIONs of all species (IMGT®, the international ImMunoGeneTics information System®; Lefranc M P et al., (1999) Nucleic Acids Res, 27(1): 209-12; Ruiz M et al., (2000) Nucleic Acids Res, 28(1): 219-21; Lefranc M P (2001) Nucleic Acids Res, 29(1): 207-9; Lefranc, M P (2003) Nucleic Acids Res, 31(1): 307-10; Lefranc M P et al., (2005) Dev Comp Immunol, 29(3): 185-203; Kaas Q et al., (2007) Briefings in Functional Genomics & Proteomics, 6(4): 253-64). All Complementarity Determining Regions (CDRs) as referred to in the present invention, are defined preferably as follows (numbering according to Kabat E A et al., supra): LCDR1: 24-34, LCDR2: 50-56, LCDR3: 89-98, HCDR1: 26-35, HCDR2: 50-65, HCDR3: 95-102.

The "non-CDR regions" of the variable domain are known as framework regions (FR). The "non-CDR regions" of the VL region as used herein comprise the amino acid sequences: 1-23 (FR1), 35-49 (FR2), 57-88 (FR3) and 99-107 (FR4). The "non-CDR regions" of the VH region as used herein comprise the amino acid sequences: 1-25 (FR1), 36-49 (FR2), 66-94 (FR3) and 103-113 (FR4).

The CDRs of the present invention may comprise "extended CDRs" which are based on the aforementioned definitions and have variable domain residues as follows: LCDR1: 24-36, LCDR2: 46-56, LCDR3:89-97, HCDR1: 26-35, HCDR2:47-65, HCDR3: 93-102. These extended CDRs are numbered as well according to Kabat et al., supra. The "non-extended CDR region" of the VL region as used herein comprise the amino acid sequences: 1-23 (FR1), 37-45 (FR2), 57-88 (FR3) and 98—approximately 107 (FR4). The "non-extended CDR region" of the V H region as used herein comprise the amino acid sequences: 1-25 (FR1), 37-46 (FR2), 66-92 (FR3) and 103—approximately 113 (FR4).

The term "Fab" or "FAB" or "Fab region" or "FAB region" as used herein includes the polypeptides that comprise the VH, CH1, VL and light chain constant immunoglobulin regions. Fab may refer to this region in isolation, or this region in the context of a full length antibody or antibody fragment.

The term "Fc" or "Fc region", as used herein includes the polypeptide comprising the constant region of an antibody heavy chain excluding the first constant region immunoglobulin region. Thus Fc refers to the last two constant region immunoglobulin regions of IgA, IgD and IgG or the last three constant region immunoglobulin regions of IgE and IgM, and the flexible hinge N-terminal to these regions. For IgA and IgM, Fc may include the J chain. For IgG, Fc comprises immunoglobulin regions Cgamma2 and Cgamma3 (Cγ2 and Cγ3) and the hinge between Cgamma1 (Cγ1) and Cgamma2 (Cγ2). Although the boundaries of the Fc region may vary, the human IgG heavy chain Fc region is usually defined to comprise residues C226 or P230 to its carboxyl-terminus, wherein the numbering is according to the EU index. Fc may refer to this region in isolation or this region in the context of an Fc polypeptide, for example an antibody.

The term "immunoglobulin constant region" as used herein refers to immunoglobulin or antibody heavy chain constant regions from human or animal species and encompasses all isotypes. Preferably, immunoglobulin constant regions are of human origin and are selected from the group consisting of, but not limited to: IGHG1 CH1, IGHG2 CH1, IGHG3 CH1, IGHG4 CH1, IGHA1 CH1, IGHA2 CH1, IGHE CH1, IGHEP1 CH1, IGHM CH1, IGHD CH1, IGHGP CH1, IGHG1 CH2, IGHG2 CH2, IGHG3 CH2, IGHG4 CH2, IGHA1 CH2, IGHA2 CH2, IGHE CH2, IGHEP1 CH2, IGHM CH2, IGHD CH2, IGHGP CH2, IGHG1 CH3, IGHG2 CH3, IGHG3 CH3, IGHG4 CH3, IGHA1 CH3, IGHA2 CH3, IGHE CH3, IGHEP1 CH3, IGHM CH3, IGHD CH3, IGHGP CH3, IGHE CH4 and IGHM CH4. Preferred "immunoglobulin constant regions" are selected from the group consisting of human IGHE CH2, IGHM CH2, IGHG1 CH3, IGHG2 CH3, IGHG3 CH3, IGHG4 CH3, IGHA1 CH3, IGHA2 CH3, IGHE CH3, IGHM CH3, IGHD CH3 and IGHGP CH3. More preferred "immunoglobulin constant regions" are selected from the group consisting of human IGHG1 CH3, IGHG2 CH3, IGHG3 CH3. IGHG4 CH3, IGHA1 CH3, IGHA2 CH3, IGHE CH3. IGHM CH3, IGHD CH3 and IGHGP CH3.

The term "epitope binding region" includes a polypeptide or a fragment thereof having minimal amino acid sequence to permit the specific binding of the immunoglobulin molecule to one or more epitopes. Naturally occurring antibodies have two epitope binding regions which are also known as antigen binding or combining sites or paratopes. Epitope binding regions in naturally occurring antibodies are confined within the CDR regions of the VH and/or VL domains wherein the amino acid mediating epitope binding are found. In addition to naturally occurring antibodies, artificial VH domains or VL domains or fragments thereof and combinations thereof can be engineered to provide epitope binding regions (Holt L J et al., (2003) Trends Biotechnol, 21(11): 484-490; Polonelli L et al., (2008) PLoS ONE, 3(6): e2371). Examples of non-immunoglobulin based epitope binding regions can be found in artificial protein domains used as "scaffold" for engineering epitope binding regions (Binz H K et al., (2005) Nat Biotechnol, 23(10): 1257-1268) or peptide mimetics (Murali R & Greene M I (2012) Pharmaceuticals, 5(2): 209-235). Preferably the term 'epitope binding region' includes the combination of one or more heavy chain variable domains and one or more complementary light chain variable domains which together forms a binding site which permits the specific binding of the immunoglobulin molecule to one or more epitopes. Examples of an epitope binding region as exemplified in the present invention include scFv and FAB.

As used herein, the term "epitope" includes a fragment of a polypeptide or protein or a non-protein molecule having antigenic or immunogenic activity in an animal, preferably in a mammal and most preferably in a human. An epitope having immunogenic activity is a fragment of a polypeptide or protein that elicits an antibody response in an animal. An epitope having antigenic activity is a fragment of a polypeptide or protein to which an antibody or polypeptide specifically binds as determined by any method well-known to one of skill in the art, for example by immunoassays. Antigenic epitopes need not necessarily be immunogenic. Preferably, the term "epitope" as used herein refers to a polypeptide sequence of at least about 3 to 5, preferably about 5 to 10 or 15 and not more than about 1,000 amino acids (or any integer there between), which define a sequence that by itself or as part of a larger sequence, binds to an antibody generated in response to such sequence. There is no critical upper limit to the length of the fragment, which may comprise nearly the full-length of the protein sequence, or even a fusion protein comprising one or more epitopes. An epitope for use in the subject invention is not limited to a polypeptide having the exact sequence of the portion of the parent protein from which it is derived. Thus the term "epitope" encompasses sequences identical to the native sequence, as well as modifications to the native sequence, such as deletions, additions and substitutions (generally conservative in nature). The epitopes of protein antigens are divided into two categories, conformational epitopes and linear epitopes, based on their structure and interaction with the epitope binding site (Goldsby R et al., (2003) "Antigens (Chapter 3)" Immunology (Fifth edition ed.), New York: W. H. Freeman and Company. pp. 57-75, ISBN 0-7167-4947-5). A conformational epitope is composed of discontinuous sections of the antigen's amino acid sequence. These epitopes interact with the paratope based on the 3-D surface features and shape or tertiary structure of the antigen. Most epitopes are conformational. By contrast, linear epitopes interact with the paratope based on their primary structure. A linear epitope is formed by a continuous sequence of amino acids from the antigen.

The term "hetero-dimeric immunoglobulin" or "hetero-dimeric fragment" or "hetero-dimer" or "hetero-dimer of heavy chains" as used herein includes an immunoglobulin molecule or part of comprising at least a first and a second polypeptide, like a first and a second region, wherein the second polypeptide differs in amino acid sequence from the first polypeptide. Preferably, a hetero-dimeric immunoglobulin comprises two polypeptide chains, wherein the first chain has at least one non-identical region to the second chain, and wherein both chains assemble, i.e. interact through their non-identical regions. More preferably the hetero-dimeric immunoglobulin, has binding specificity for at least two different ligands, antigens or binding sites, i.e. is bispecific. Hetero-dimeric immunoglobulin as used herein includes but is not limited to full length bispecific antibodies, bispecifc Fab, bispecifc F(ab')$_2$, bispecific scFv fused to an Fc region, diabody fused to an Fc region and domain antibody fused to an Fc region.

The term "homo-dimeric immunoglobulin" or "homo-dimeric fragment" or "homo-dimer" or "homo-dimer of heavy chains" as used herein includes an immunoglobulin molecule or part of comprising at least a first and a second polypeptide, like a first and a second region, wherein the second polypeptide is identical in amino acid sequence to the first polypeptide. Preferably, a homo-dimeric immunoglobulin comprises two polypeptide chains, wherein the first chain has at least one identical region to the second chain, and wherein both chains assemble, i.e. interact through their identical regions. Preferably, a homo-dimeric immunoglobulin fragment comprises at least two regions, wherein the first region is identical to the second region, and wherein both regions assemble, i.e. interact through their protein-protein interfaces.

For all immunoglobulin constant regions included in the present invention, numbering can be according to the IMGT® (IMGT®; supra).

For all human CH1, CH2, CH3 immunoglobulin heavy chain constant regions selected from the group consisting of IGHG1, IGHG2, IGHG3 and IGHG4, numbering can be according to the "EU numbering system" (Edelman G M et al., (1969) Proc Natl Acad Sci USA, 63(1): 78-85). A complete correspondence for the human CH1, hinge, CH2 and CH3 constant regions of IGHG1 can be found at the IMGT database (IMGT®; supra).

For the human kappa immunoglobulin light chain constant region (IGKC), numbering can be according to the "EU numbering system" (Edelman G M et al., supra). A complete correspondence for the human CK region can be found at IMGT database (IMGT®; supra).

For the human lambda immunoglobulin light chain constant regions (IGLC1, IGLC2, IGLC3, IGLC6 and IGLC7), numbering can be according to the "Kabat numbering system" (Kabat E A et al., supra). A complete correspondence for human IGLC regions can be found at the IMGT database (IMGT®; supra).

The human IGHG1 immunoglobulin heavy chain constant regions as referred to herein have the following region boundaries: CH1 region (EU numbering: 118-215), Hinge γ1 region (EU numbering: 216-230), CH2 region (EU numbering: 231-340) and CH3 region (EU numbering: 341-447). The human CK region referred herein spans residues 108 to 214 (EU numbering). The human IGLC1, IGLC2, IGLC3, IGLC6 and IGLC7 regions referred herein span residues 108-215 (Kabat numbering).

The terms "amino acid" or "amino acid residue" as used herein includes natural amino acids as well as non-natural amino acids. Preferably natural amino acids are included.

The term "modification" or "amino acid modification" herein includes an amino acid substitution, insertion and/or deletion in a polypeptide sequence. The terms "substitution" or "amino acid substitution" or "amino acid residue substitution" as used herein refers to a substitution of a first amino acid residue in an amino acid sequence with a second amino acid residue, whereas the first amino acid residue is different from the second amino acid residue i.e. the substituted amino acid residue is different from the amino acid which has been substituted. For example, the substitution R94K refers to a variant polypeptide, in which the arginine at position 94 is replaced with a lysine. For example 94K indicates the substitution of position 94 with a lysine. For the purposes herein, multiple substitutions are typically separated by a slash or a comma. For example, "R94K/L78V" or "R94K, L78V" refers to a double variant comprising the substitutions R94K and L78V. By "amino acid insertion" or "insertion" as used herein is meant the addition of an amino acid at a particular position in a parent polypeptide sequence. For example, insert –94 designates an insertion at position 94. By "amino acid deletion" or "deletion" as used herein is meant the removal of an amino acid at a particular position in a parent polypeptide sequence. For example, R94—designates the deletion of arginine at position 94.

In certain embodiments, the terms "decrease", "reduce", or "reduction" in binding to Protein A refers to an overall decrease of at least 25%, 30%, 40%, 50%, 60%, 70%, 80%, 85%, 90%, 95%, 97%, or 99% up to 100% (elimination) in the binding of a modified immunoglobulin or fragment thereof to Protein A detected by standard art known methods such as those described herein, as compared to a parental i.e. unmodified immunoglobulin or wild-type IgG or an IgG having the wild-type human IgG Fc region. In certain embodiments these terms alternatively may refer to an overall decrease of 10-fold (i.e. 1 log), 100-fold (2 logs), 1,000-fold (or 3 logs), 10,000-fold (or 4 logs), or 100,000-fold (or 5 logs).

The terms "eliminate", "abrogate", "elimination" or "abrogation" of binding to Protein A refers to an overall decrease of 100% in the binding of a modified immunoglobulin or fragment thereof to Protein A i.e. a complete loss of the binding of a modified immunoglobulin or fragment thereof to Protein A, detected by standard art known methods such as those described herein, as compared to a parental i.e. unmodified immunoglobulin or wild-type IgG or an IgG having the wild-type human IgG Fc region.

Similarly, the terms "decrease". "reduce", or "reduction" in binding to an affinity reagent refers to an overall decrease of at least 25%, 30%, 40%, 50%, 60%, 70%, 80%, 85%, 90%, 95%, 97%, or 99% up to 100% (elimination) in the binding of a modified immunoglobulin or fragment thereof to the affinity reagent detected by standard art known methods such as those described herein, as compared to a parental, i.e. unmodified immunoglobulin or wild-type IgG or an IgG having the wild-type human IgG Fc region. In certain embodiments these terms alternatively may refer to an overall decrease of 10-fold (i.e. 1 log), 100-fold (2 logs), 1,000-fold (or 3 logs), 10,000-fold (or 4 logs), or 100,000-fold (or 5 logs).

The terms "eliminate", "abrogate", "elimination" or "abrogation" of binding to an affinity reagent refers to an overall decrease of 100% in the binding of a modified immunoglobulin or fragment thereof to the affinity reagent i.e. a complete loss of the binding of a modified immunoglobulin or fragment thereof to the affinity reagent detected by standard art known methods such as those described herein, as compared to a parental, i.e. unmodified immunoglobulin or wild-type IgG or an IgG having the wild-type human IgG Fc region.

"Bispecific antibodies" are monoclonal antibodies that have binding specificities for at least two different antigens. In certain embodiments, the bispecific antibodies are bispecific antibodies with one or more amino acid modifications in the VH region relative to the parental antibody. In certain embodiments, bispecific antibodies may be human or humanized antibodies. Bispecific antibodies may also be used to localize cytotoxic agents to cells which express a target antigen. These antibodies possess a target-antigen-binding arm and an arm which binds a cytotoxic agent, such as, e.g., saporin, anti-interferon-α, vinca alkaloid, ricin A chain, methotrexate or radioactive isotope hapten. Bispecific antibodies can be prepared as full length antibodies or antibody fragments. Methods for making bispecific antibodies are known in the art. Traditionally, the recombinant production of bispecific antibodies is based on the co-expression of two immunoglobulin heavy chain-light chain pairs, where the two heavy chains have different specificities (Milstein and Cuello, (1983) Nature, 305: 537-40). Because of the random assortment of immunoglobulin heavy and light chains, these hybridomas (quadromas) produce a potential mixture of different antibody molecules, of which only one has the correct bispecific structure. The purification of the correct molecule, which is usually done by affinity chromatography steps, is rather cumbersome and the product yields are low. Similar procedures are disclosed in WO1993/08829 and in Traunecker et al., (1991) EMBO J, 10: 3655-9. According to a different approach, antibody variable regions with the desired binding specificities (antibody-antigen combining sites) are fused to immunoglobulin constant region sequences. The fusion, for example, is with an immunoglobulin heavy chain constant region, comprising at least part of the hinge, CH2 and CH3 regions. In certain embodiments, the first heavy-chain constant region (CH1), containing the site necessary for light chain binding, is present in at least one of the fusions. DNAs encoding the immunoglobulin heavy chain fusions and, if desired, the immunoglobulin light chain, are inserted into separate expression vectors and are co-transfected into a suitable host organism. This provides for flexibility in adjusting the mutual proportions of the three polypeptide fragments in embodiments when unequal ratios of the three polypeptide chains used in the construction provide the optimum yields. It is, however, possible to insert the coding sequences for two or all three polypeptide chains in one expression vector when the expression of at least two polypeptide chains in equal ratios results in high yields or when the ratios are of no particular significance.

Bispecific antibodies include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980) and for treatment of HIV infection (WO1991/00360, WO1992/00373 and EP03089). Heteroconjugate antibodies may be made using any convenient cross-linking method. Suitable cross-linking agents are well known in the art (see U.S. Pat. No. 4,676,980), along with a number of cross-linking techniques. Antibodies with more than two valencies are also contemplated. For example, trispecific antibodies can be prepared (see Tutt A et al. (1991) J. Immunol. 147: 60-9).

In some embodiments the present disclosure provides a bispecific hetero-dimeric immunoglobulin or fragment thereof or a bispecific full-length antibody which binds to CD3 and a disease associated antigens selected from within the groups of: tumor antigens, cytokines, vascular growth factors and lympho-angiogenic growth factors. Preferably the bispecific hetero-dimeric immunoglobulin or fragment thereof or the bispecific antibody binds to CD3 and a disease associated antigen selected from the group consisting of: CD33, TROP2, CD105, GD2, GD3, CEA, VEGFR1, VEGFR2, NCAM, CD133, CD123, ADAM17, MCSP, PSCA, FOLR1, CD19, CD20, CD38, EpCAM, HER2, HER3, EGFR, PSMA, IgE, Integrin a4b1, CCR5, LewisY, FAP, MUC-1, Wue-1, MSP, EGFRvIII, P glycoprotein, AFP, ALK, BAGE proteins, CD30. CD40, CTLA4, ErbB3, ErbB4, Mesothelin, OX40, CA125, CAIX, CD66e, cMet, EphA2, HGF/SF, MUC1, Phosphatidylserine, TAG-72, TPBG, β-catenin, brc-abl, BRCA1, BORIS, CA9, caspase-8, CDK4, Cyclin-B1, CYP1B1, ETV6-AML, Fra-1, FOLR1, GAGE-1, GAGE-2, GloboH, glypican-3, GM3, gp100, HLA/B-raf, HLA/k-ras, HLA/MAGE-A3, hTERT, LMP2, MAGE1, MAGE2, MAGE3, MAGE4, MAGE6, MAGE12, MART-1, ML-IAP, Muc2, Muc3, Muc4, Muc5, Muc16, MUM1, NA17, NY-BR1, NY-BR62, NY-BR-85, NY-ESO1, p15, p53, PAP, PAX3 PAX5, PCTA-1, PLAC1, PRLR, PRAME, RAGE proteins, Ras, RGS5. Rho, SART-1, SART-3, Steap-1, Steap-2, survivin, TAG-72, TGF-β, TMPRSS2, Tn, TRP-1, TRP-2, tyrosinase, uroplakin-3, PSMA. Preferably the bispecific hetero-dimeric immunoglobulin or fragment thereof or the bispecific antibody binds to CD3 and HER2 or CD3 and CD38 or CD3 and OX40.

Protein A:

Protein A is a cell wall component produced by several strains of Staphylococcus aureus which consists of a single polypeptide chain. The Protein A gene product consists of five homologous repeats attached in a tandem fashion to the pathogen's cell wall. The five domains are approximately 58 amino acids in length and denoted EDABC, each exhibiting immunoglobulin binding activity (Tashiro M & Montelione G T (1995) Curr. Opin. Struct. Biol., 5(4): 471-481). The five homologous immunoglobulin binding domains fold into a three-helix bundle. Each domain is able to bind proteins from many mammalian species, most notably IgGs (Hober S et al., (2007) J. Chromatogr. B Analyt. Technol. Biomed. Life Sci., 848(1): 40-47). Protein A binds the heavy chain of most immunoglobulins within the Fc region but also within the Fab region in the case of the human VH3 family (Jansson B et al, (1998) FEMS Immunol. Med. Microbiol., 20(1): 69-78). Protein A binds IgG from various species including human, mouse, rabbit and guinea pig but does not bind human IgG3 (Hober S et al., (2007) supra). The inability of human IgG3 to bind Protein A can be explained by the H435R and Y436F substitutions in the human IgG3 Fc region (EU numbering, Jendeberg et al., (1997) J. Immunol. Methods, 201(1): 25-34). Besides IgG, Protein A also interacts with IgM and IgA.

Amongst human VH subclasses, VH3 is the only subclass to bind Protein A (Graille M et al., (2000) Proc. Natl. Acad. Sci. USA 97(10): 5399-5404), and all five domains of Protein A are known to bind this variable domain subclass (Jansson B et al, (1998) FEMS Immunol. Med. Microbiol., 20(1): 69-78. VH3 based immunoglobulins or fragments thereof are of major importance to the biotechnology industry. VH3 based molecules have been extensively developed since their ability to bind Protein A facilitates their functional pre-screening, and as such many synthetic or donor based phage display libraries or transgenic animal technologies used for antibody discovery are based on the VH3 subclass. In addition VH3 based molecules are often selected for their good expression and stability over other known heavy chain variable domain subclasses.

The capacity of Protein A to bind antibodies with such high affinity is the driving motivation for its industrial scale use in biologic pharmaceuticals. Protein A used for production of antibodies in bio-pharmaceuticals is usually produced recombinantly in *E. coli* and functions essentially the same as native Protein A (Liu H F et al., (2010) MAbs, 2(5): 480-499). Most commonly, recombinant Protein A is bound to a stationary phase chromatography resin for purification of antibodies. Optimal binding occurs at pH8.2, although binding is also good at neutral or physiological conditions (pH 7.0-7.6). Elution is usually achieved through pH shift towards acidic pH (glycine-HCl, pH2.5-3.0). This effectively dissociates most protein-protein and antibody-antigen binding interactions without permanently affecting protein structure. Nevertheless, some antibodies and proteins are damaged by low pH and it is best to neutralize immediately after recovery by addition of ⅒th volume of alkaline buffer such as 1 M Tris-HCl, pH 8.0 to minimize the duration of time in the low-pH condition.

There are various commercially available Protein A chromatography resins. The main differences between these media are the support matrix type, Protein A ligand modification, pore size and particle size. The differences in these factors give rise to differences in compressibility, chemical and physical robustness, diffusion resistance and binding capacity of the adsorbents (Hober S et al., (2007), supra). Examples of Protein A chromatography resins include but are not limited to the MabSelect SuRe™ Protein A resin and MabSelect™ Protein A resin from GE Healthcare as used in examples.

The term "chromatography" refers to protein liquid chromatography and includes fast protein liquid chromatography (FPLC) which is a form of liquid chromatography that is often used to analyze or purify mixtures of proteins. As in other forms of chromatography, separation is possible because the different components of a mixture have different affinities for two materials, a moving fluid (the mobile phase) which passes through a porous solid (the stationary phase). In FPLC, the mobile phase is an aqueous solution, or "buffer". The buffer flow rate can be operated under gravity flow or controlled by a positive-displacement pump which is normally kept at a constant rate, while the composition of the buffer can be varied by drawing fluids in different proportions from two or more external reservoirs. The stationary phase is a resin composed of beads, usually of cross-linked agarose, packed into a cylindrical glass or plastic column. FPLC resins are available in a wide range of bead sizes and surface ligands depending on the application.

The process of "affinity chromatography" involves the use of an affinity reagent as ligands which are cross-linked to the stationary phase and that have binding affinity to specific molecules or a class of molecules. Ligands can be biomolecules, like protein ligands or can be synthetic molecules. Both types of ligand tend to have good specificity. The most commonly used protein ligand in production is the affinity reagent Protein A. In affinity chromatography when the solution (for example a crude cell supernatant containing a protein of interest) is loaded onto to the column the target protein is usually adsorbed while allowing contaminants (other proteins, lipids, carbohydrates, DNA, pigments, etc.) to pass through the column. The adsorbent itself is normally packed in a chromatography column; though the adsorption stage can be performed by using the adsorbent as a stirred slurry in batch binding mode. The next stage after adsorption is the wash stage, in which the adsorbent is washed to remove residual contaminants. The bound protein is then eluted in a semi-pure or pure form. Elution is normally achieved by changing the buffer or salt composition so that the protein can no longer interact with the immobilized ligand and is released. In some instances the protein of interest may not bind the affinity resin and affinity chromatography is directed at binding unwanted contaminants and the unbound fraction is therefore collected to isolate the protein of interest. Affinity chromatography can be performed in a fixed bed or a fluidised bed.

The term "gradient mode chromatography" refers to a chromatography method wherein the proportion of the "elution" buffer (buffer B) is increased from 0% to 100% in a gradual or stepwise manner.

The terms "capture-elution mode chromatography" or "capture-elution purification mode" or "capture-elution purification" refers to a chromatography method wherein the proportion of the "elution" buffer (buffer B) is not increased from 0% to 100% in a gradual or stepwise manner but rather directly applied at a 100% after capture and optionally a wash step with running buffer (buffer A).

Development of Hetero-Dimeric Immunoglobulins Targeting CD3

The present invention provides an epitope binding region that binds the CD3 protein complex comprising the heavy and light chain CDRs as described supra and further comprising a heavy chain variable framework region that is the product of or derived from human gene IGHV3-23*04 (SEQ ID NO: 22). The heavy chain variable framework region comprises at least one amino acid modification from the corresponding framework region of the heavy chain variable region of the corresponding murine antibody OKT3 comprising the amino acid sequence of SEQ ID NO: 18. Preferably the amino acid modification is an amino acid substitution. Typically, no more than seven, preferably no more than six, preferably no more than five, preferably no more than four, more preferably no more than three, even more preferably no more than two, most preferably no more than one amino acid modifications are performed within a framework region. In some embodiments the present disclosure provides an epitope binding region that binds to the CD3 protein complex, wherein the amino acid modification of the framework regions of the heavy chain variable region comprise an amino acid substitution at amino acid position selected from the group consisting of: 34, 48, 49, 58, 69, 71 and 73 and wherein the amino acid position of each group member is indicated according to the Kabat numbering. Preferably, amino acid substitutions of the framework regions of the heavy chain variable region are selected from the group consisting of: I34M, V48I, A49G, R58N, R58Y, I69L, A71T and T73K. Preferred amino acid substitution of the framework regions of the heavy chain variable region are at amino acid positions selected from the group consisting of 34, 49 and 71. More preferred amino acid substitutions of the framework regions of the heavy chain variable region are selected from the group consisting of I34M, A49G and A71T.

In a further aspect, the epitope binding region of the first polypeptide that binds the CD3 protein complex comprises a light chain variable framework region that is the product of or derived from a human gene selected from the group consisting of: IGKV1-39*01 (SEQ ID NO: 23) and IGKV3-20*01 (SEQ ID NO: 24). The light chain variable framework region comprises at least one amino acid modification from the corresponding framework region of the light chain variable region of the corresponding murine antibody OKT3 comprising the amino acid sequence of SEQ ID NO: 19. Preferably the amino acid modification is an amino acid substitution. Typically, no more than eight, preferably no more than seven, preferably no more than six, preferably no more than five, preferably no more than four, more preferably no more than three, even more preferably no more than two, most preferably no more than one amino acid modifications are performed within a framework region. In some embodiments the present disclosure provides an epitope binding region that binds to the CD3 protein complex, wherein the amino acid modification of the framework regions of the light chain variable region sequence comprises an amino acid substitution at amino acid position selected from the group consisting of: 4, 33, 34, 46, 47, 66, 71 and 96. Preferably, amino acid substitutions of the framework regions of the light chain variable region are selected from the group consisting of: M4L, V33M, A34N, L46R, L47W, R66G, F71Y and P96F. Preferred amino acid substitution of the framework regions of the light chain variable region are at amino acid positions selected from the group consisting of 4, 46 and 47. More preferred amino acid substitutions of the framework regions of the light chain variable region are selected from the group consisting of M4L, L46R, L47W and F71Y. In some embodiments the epitope binding region of the first polypeptide that binds to the CD3 protein complex may comprise amino acid modifications of the framework regions of the heavy chain variable region sequence as set out above and amino acid modifications of the framework regions of the light chain variable region sequence as set out above.

The present disclosure also provides an antibody or fragment thereof that binds to the CD3 protein complex that comprises a heavy chain sequence selected from the group consisting of SEQ ID NOs: 27 to 38, 64-68 and 359, preferably selected consisting of SEQ ID NO: 359. The present disclosure also provides an antibody or fragment thereof that binds to the CD3 protein complex that comprises a light chain sequence selected from the group consisting of SEQ ID NOs: 39 to 47, 69 to 90 and 360 preferably consisting of SEQ ID NO: 360.

Given that each of these heavy and light chain variable region sequences can bind to the CD3 protein complex, the heavy and light chain variable region sequences can be "mixed and matched" to create anti-CD3 binding molecules of the invention. CD3 binding of such "mixed and matched" antibodies can be tested using the binding assays described e.g. in the Examples.

Engineering of the Inmmunoglobulin Constant Region to Promote Hetero-Dimer Formation Over Homo-Dimer Formation Methods to produce hetero-dimeric immunoglobulins are known in the art and one of the simplest methods relies on expressing the two distinct immunoglobulin chains in a single cell (WO95/33844, Lindhofer H & Thierfelder S). Without engineering, this straightforward method is limited by the formation of homo-dimeric species over the hetero-dimer of interest (Kufer P et al., (2004) Trends Biotechnol., 22(5): 238-244). When using complementary technologies that will enhance heavy chain hetero-dimerization (Merchant A M et al., (1998) Nat. Biotechnol., 16(7): 677-681), greater hetero-dimer production can be achieved but still results in the production of a significant amount of undesirable homo-dimers (Jackman J et al., (2010) J Biol Chem., 285(27):20850-9, Klein C et al., (2012) MAbs, 4(6):653-63). The present invention therefore utilises the BEAT® technology described method (PCT publication No: WO2012/131555), which is based on a unique concept of bio-mimicry that exhibit superior hetero-dimerisation over prior art methods. The BEAT technology is based on an interface exchange between naturally occurring homo or hetero-dimeric immunoglobulin domain pairs to create new hetero-dimers which can be used as building blocks for Fc-based bispecific antibodies.

In one aspect, the present invention provides a hetero-dimeric immunoglobulin or fragment thereof comprising first and second polypeptides comprising an engineered immunoglobulin constant region with a modified CH3 domain having a protein-protein interface, wherein the protein-protein interface of the first polypeptide comprises an amino acid substitution at a position selected from the group consisting of: 3, 5, 7, 20, 22, 26, 27, 79, 81, 84, 84.2, 85.1, 86, 88 and 90 (IMGT® numbering), and wherein the protein-protein interface of the second polypeptide comprises an amino acid substitution at position 84.4 and at a position selected from the group consisting of 3, 5, 7, 20, 22, 26, 27, 79, 81, 84, 84.2, 85.1, 86, 88 and 90 (IMGT® numbering).

In a further embodiment, the present invention provides a hetero-dimeric immunoglobulin or fragment thereof, wherein the first and second polypeptides comprise an engineered immunoglobulin constant region with a modified CH3 domain having a protein-protein interface, wherein the protein-protein interface of the first polypeptide comprises an amino acid substitution at position 88 and at a position selected from the group consisting of: 3, 5, 7, 20, 22, 26, 27, 79, 81, 84, 84.2, 85.1, 86 and 90 (IMGT® numbering), and wherein the protein-protein interface of the second polypeptide comprises an amino acid substitution at position 85.1 and/or 86 and at a position selected from the group consisting of 3, 5, 7, 20, 22, 26, 27, 79, 81, 84, 84.2, 84.4, 88 and 90 (IMGT® numbering), wherein the amino acid residue substituted at position 88 in the first engineered immunoglobulin constant region is interacting with the amino acid residue substituted at position 85.1 and/or 86 in the second engineered immunoglobulin constant region, wherein the amino acid position of each group member is indicated according to the IMGT® numbering.

Preferably the amino acid residue which is substituted in the protein-protein interface of the first engineered immunoglobulin constant region at position 88 is 88W and conservative amino acid substitutions thereof, wherein the amino acid position is indicated according to IMGT® numbering. More preferably, the amino acid residue which is substituted in the protein-protein interface of the first engineered immunoglobulin constant region at position 88 is 88W and wherein the further amino acid residue substituted in the protein-protein interface of the first engineered immunoglobulin constant region is selected from the group consisting of: 3A, 20V, 20T, 20A, 20N, 20Q, 20E, 20S, 20K, 20W, 22A, 22G, 22T, 22L, 22I, 22V, 26R, 26Q, 26T, 26K, 26V, 26S, 26N, 26E, 79Y, 85.1T, 85.1M, 85.1A, 85.1S, 85.1R, 85.1H, 85.1K, 85.1F, 85.1C, 85.1N, 85.1W, 86S, 86I, 86T, 86H, 86Q, 86V, 86W, 86Y, 86F and 90N, wherein the amino acid position is indicated according to the IMGT® numbering.

Preferably the amino acid residue which is substituted at position 85 and 86 in the protein-protein interface of the second engineered immunoglobulin constant region is selected from the group consisting of: 85.1A, 85.1S, 85.1C and 86S and conservative amino acid substitutions thereof (IMGT® numbering). More preferably the amino acid residue which is substituted in the protein-protein interface of the second engineered immunoglobulin constant region is selected from the group consisting of: 85.1A, 85.1S, 85.1C and 86S and wherein the further amino acid residue substituted in the protein-protein interface of the second engineered immunoglobulin constant region is selected from the group consisting of: 3E, 5A, 7F, 20T, 22V, 26T, 81D, 84L, 84.2E, 88R and 90R and conservative amino acid substitutions thereof (IMGT® numbering).

In a preferred embodiment the amino acid residue which is substituted in the protein-protein interface of the first engineered immunoglobulin constant region at position 88 is 88W and wherein the further amino acid residue substituted in the protein-protein interface of the first engineered immunoglobulin constant region is: 3A, 20K, 22V, 26T, 79Y, 85.1S, 86V and 90N and, wherein the amino acid residues which are substituted in the protein-protein interface of the second engineered immunoglobulin constant region at positions 85.1 and 86 are 85.1A, 85.1S or 85.1A and 86S and wherein the further amino acid residue substituted in the protein-protein interface of the second engineered immunoglobulin constant region is: 3E, 5A, 7F, 20T, 22V, 26T, 81D, 84L, 84.2E, 84.4Q, 88R and 90R (IMGT® numbering).

In an alternative embodiment, the present invention provides a hetero-dimeric immunoglobulin or fragment thereof, wherein the first and second polypeptides comprise an engineered immunoglobulin constant region with a modified CH3 domain having a protein-protein interface, wherein the protein-protein interface of the first polypeptide comprises an amino acid substitution at position 20, and at a position selected from the group consisting of: 3, 5, 7, 22, 26, 27, 79, 81, 84, 84.2, 85.1, 86, 88 and 90 and, wherein the protein-protein interface of the second polypeptide comprises an amino acid substitution at position 26 and at a position selected from the group consisting of: 3, 22, 27, 79, 81, 84, 85.1, 86, and 88, wherein the amino acid residue substituted at position 20 in the first engineered immunoglobulin constant region is interacting with the amino acid residue substituted at position 26 in the second engineered immunoglobulin constant region, wherein the amino acid position of each group member is indicated according to the IMGT® numbering.

Preferably the amino acid residues which are substituted in the protein-protein interface of the first engineered immunoglobulin chain comprise the amino acid residues at positions 20 and 22, and optionally a further amino acid residue at a position selected from the group consisting of: 3, 5, 7, 26, 27, 79, 81, 84, 84.2, 84.4, 85.1, 86, 88 and 90 and, wherein the amino acid residues which are substituted in the protein-protein interface of the second engineered immunoglobulin chain comprise the amino acid residues at positions 26 and at a further position selected from the group consisting of: 3, 5, 7, 20, 22, 27, 79, 81, 84, 84.2, 84.4, 85.1, 86, 88 and 90, wherein the amino acid position of each group member is indicated according to the IMGT® numbering. Preferably the amino acid residues which are substituted in the protein-protein interface of the first engineered immunoglobulin chain comprise the amino acid residues at positions 20 and 22, and optionally a further amino acid residue at a position selected from the group consisting of: 3, 5, 7, 26, 27, 79, 81, 84, 84.2, 84.4, 85.1, 86, 88 and 90 and, wherein the amino acid residues which are substituted in the protein-protein interface of the second engineered immunoglobulin chain comprise the amino acid residues at positions 26 and 86 and optionally at a further position selected from the group consisting of 3, 5, 7, 20, 22, 27, 79, 81, 84, 84.2, 84.4, 85.1, 88 and 90, wherein the amino acid position of each group member is indicated according to the IMGT® numbering.

More preferably the amino acid residue which is substituted at position 20 in the protein-protein interface of the first engineered immunoglobulin constant region is selected from the group consisting of 20V, 20T, 20A, 20N, 20Q, 20K, 20S, 20W and 20E and wherein the further amino acid residue substituted in the protein-protein interface of the first engineered immunoglobulin constant region is selected from the group consisting of 3A, 22A, 22G, 22L, 22I, 22V, 22T, 26K, 26R, 26Q, 26T, 26V, 26S, 26N, 26E, 79Y, 85.1W, 85.1F, 85.1T, 85.1M, 85.1A, 85.1S, 85.1R, 85.1H, 85.1K, 85.1C, 85.1N, 86W, 86Y, 86S, 86I, 86H, 86Q, 86V, 86T, 86F, 88Q, 88L, 88V, 88R, 88E, 88T, 88I, 88Y, 88K, 88W and 90N, and wherein the amino acid residue which is substituted at position 26 in the protein-protein interface of the second engineered immunoglobulin constant region is selected from the group consisting of 26T and 26E and conservative amino acid substitutions thereof, wherein the amino acid position is indicated according to the IMGT® numbering.

In a most preferred embodiment the amino acid residue which is substituted in the protein-protein interface of the first engineered immunoglobulin constant region at position 20 is 20K and wherein the further amino acid residue substituted in the protein-protein interface of the first engineered immunoglobulin constant region is 3A, 22V, 26T, 79Y, 85.1S, 86V, 88W and 90N and, wherein the amino acid residues which are substituted in the protein-protein interface of the second engineered immunoglobulin constant region at position 26 is 26T and wherein the further amino acid residue substituted in the protein-protein interface of the second engineered immunoglobulin constant region is 3E, 5A, 7F, 20T, 22V, 81D, 84L, 84.2E, 84.4Q, 85.1C/S/A, 86S, 88R and 90R (IMGT® numbering).

Development of Hetero-Dimeric Immunoglobulins Targeting CD3 and a Disease Associated Antigen As a first step (Example 1), the substitutions that reduce or abrogate binding to Protein A were assayed in homo-dimeric immunoglobulins based on FAB or scFv fragments. It was found that the presence of a variable heavy chain domain of the VH3 subclass within the heavy chain which has substitutions for reduced or no binding to Protein A, hampers any differential affinity methods based on Protein A. Solutions to these major impediments were found in the forms of framework substitutions that reduce or abrogate Protein A binding to the VH3 subclass for the differential affinity methods based on Protein A.

In a second step (Example 2.1), a humanised antibody targeting the human CD3 (epsilon subunit) was generated by grafting the CDRs of a murine anti-CD3 antibody onto IGVH3-23 and IGVK1 or IGVK3 human germline frameworks. The best humanised variants had the Protein A binding site present in their VH domain abrogated using a G65S or N82aS substitution (Kabat numbering). These variants were formatted as FAB or scFv fragments.

In a third step, antigen binding sites of antibodies targeting disease associated antigens were generated. CDRs of murine antibodies could be grafted onto the human germline frameworks IGVH3-23 and IGVK1 (Examples 2.3, 2.4 and 2.6-2.10). Alternatively CDRs of antibodies isolated from phage display libraries could be based on the VH3 variable domain subclass or grafted onto the human germline frameworks IGVH3-23 and IGVK1 (Examples 2.5 and 2.6). The Protein A binding site in the VH domain of the epitope binding region was abrogated using the G65S or N82aS substitutions (Kabat numbering).

In a fourth step, hetero-dimeric antibodies were produced based on the BEAT® technology (as described in WO2012/131555) in which the anti-CD3 antibody from Example 2.1 and the epitope binding region of the disease associated antigen as described in Examples 2.2-2.10 were used in an scFv-FAB format or vice versa (Example 3.1). Since a difference in the number of Protein A binding sites between homo- and hetero-dimeric species can be used to isolate the hetero-dimeric species by Protein A chromatography, the bispecific antibodies of the present invention were engineered to result in one of the two homo-dimeric species having no Protein A binding site and therefore no binding to Protein A resin. Furthermore, in order to improve the safety profile of the BEAT antibodies, the Fc receptor binding was reduced or eliminated by engineering the two substitutions L234A and L235A (EU numbering) into the lower hinge region of the Fc region.

EXAMPLES

Materials and Methods

Construction of Expression Vectors for Transient Mammalian Cell Expression cDNAs encoding the different polypeptide chains in part or in full were first gene synthetized by GENEART AG (Regensburg, Germany) and modified using standard molecular biology techniques. PCR products were digested with appropriate DNA restriction enzymes, purified and ligated in a modified pcDNA3.1 plasmid (Invitrogen AG, Zug, Switzerland) carrying a CMV promoter and a bovine hormone poly-adenylation (poly(A)) previously digested with the same DNA restriction enzymes. All polypeptide chains were independently ligated in this expression vector where secretion was driven by the murine VJ2C leader peptide.

Expression of Recombinant Proteins

Antibodies, ScFv-Fc fusion proteins, BEAT antibodies and antigens were expressed as described below unless otherwise indicated. For transient expression, equal quantities of each engineered chains vectors were co-transfected into suspension-adapted HEK293-EBNA cells (ATCC-LGL standards, Teddington, UK; Cat. No: CRL-10852) using Polyethyleneimine (PEI; Sigma, Buchs, Switzerland). Typically, 100 ml of cells in suspension at a density of 0.8-1.2 million cells per ml is transfected with a DNA-PEI mixture.

When recombinant expression vectors encoding each engineered chain genes are introduced into the host cells, the immunoglobulin construct is produced by further culturing the cells for a period of 4 to 5 days to allow for secretion into the culture medium (EX-CELL 293, HEK293-serum-free medium (Sigma), supplemented with 0.1% pluronic acid, 4 mM glutamine and 0.25 µg/ml geneticin). Cell-free culture supernatants containing the secreted immunoglobulins were prepared by centrifugation followed by sterile filtration and used for further analysis.

Differential Protein A Affinity Chromatography (Example 1)
Purification of Fc 133 Fragment and Homo-Dimeric scFv-Fc Immunoglobulins
Capture-Elution Mode Chromatography Supernatants were conditioned with 0.1 volume (V) of 1M Tris-HCl pH 8.0 prior purification. Protein G Sepharose™ 4 Fast Flow (GE Healthcare Europe GmbH, Glattbrugg, Switzerland; catalogue number 17-0618-01) was added to conditioned supernatants. Mixtures were incubated overnight at 4° C. After incubation, bound proteins were washed with 10CVs of PBS pH 7.4, eluted with 4 column volumes (CVs) of 0.1 M Glycine pH 3.0 and neutralised with 0.1V of 1M Tris-HCl pH8.0. Supernatant, flow through and elution fractions were analysed under non-reduced conditions by SDS-PAGE (NuPAGE Bis-Tris 4-12% acrylamide, Invitrogen AG, Basel, Switzerland).

Gradient Mode Chromatography

Post production, cell-culture supernatants containing the Fc 133 fragment were first purified in capture-elution mode chromatography using Protein G Sepharose™ 4 Fast Flow (above). Eluted material from capture-elution mode chromatography were subsequently loaded onto a 1 ml HiTrap™ MabSelect SuRe™ Protein A column (Protein A binding site mutants). The column was pre-equilibrated in 0.2M phosphate citrate buffer pH 8.0 and operated on an ÄKTApurifier™ chromatography system (both column and instrument from GE Healthcare Europe GmbH; column catalogue No: 11-0034-93) at a flow rate of 1 ml/min. Elution was performed with a pH linear gradient combining various amounts of two buffers (running buffer (A): 0.2M phosphate citrate buffer pH 8.0 and elution buffer (B): 0.04M phosphate citrate buffer pH 3.0. The linear gradient went from 0% B to 100% B in five column volumes (CVs). Eluted fractions were neutralised with 0.1V of 1M Tris-HCl pH 8.0. Supernatant, flow through and elution fractions were analysed under non-reduced conditions by SDS-PAGE (NuPAGE Bis-Tris 4-12% acrylamide, Invitrogen AG, Basel, Switzerland).

Purification of Homo-Dimeric FAB-Fc Immunoglobulins and FAB Fragments.

Post production, cell culture supernatants were conditioned with 0.1V of 1M Tris-HCl pH 8.0. Protein L resin (Genescript, Piscataway, USA) was added to the conditioned supernatant and incubated overnight at 4° C. After incubation, bound proteins were washed with ten CVs of PBS pH7.4, eluted with 4CVs of 0.1M Glycine pH 3.0, and finally neutralised with 0.1V of 1M Tris-HCl pH 8.0. To assess Protein A binding, Protein L purified FAB were injected on a 1 ml HiTrap MabSelect™ column (GE Healthcare Europe GmbH, Glattbrugg, Switzerland) at pH8.0 (Citric acid/Na$_2$HPO$_4$ buffer). Elution was performed with a pH linear gradient combining various amounts of two buffers (running buffer (A): 0.2 M phosphate citrate buffer pH8.0 and elution buffer (B): 0.04 M phosphate citrate buffer pH3.0). The linear gradient went from 0% B to 100% B in 5CVs. Eluted fractions were neutralised with 0.1V of 1M Tris-HCl pH8.0. Supernatant, flow through and elution fractions were analysed under non-reduced conditions by SDS-PAGE (NuPAGE Bis-Tris 4-12% acrylamide, Invitrogen AG, Basel, Switzerland).

Purification and Testing of VH3 Based Homo-Dimeric FAB-Fc and scFv-Fc Immunoglobulins Abrogated for Protein A Binding in their Fc and VH3 Domains.

Purification scheme included a capture-elution mode chromatography followed by a gradient mode chromatography according to the procedure described above.

Differential Protein A Affinity Chromatography (Examples 1 & 3)

Post production, cell-free supernatants were loaded onto a 1 ml HiTrap™ MabSelect SuRe™ Protein A column pre-equilibrated in 0.2M phosphate citrate buffer pH 6.0 and operated on an ÄKTApurifier™ chromatography system (both from GE Healthcare Europe GmbH; column Cat. No: 11-0034-93) at a flow rate of 1 ml/min. Running buffer was 0.2 M phosphate citrate buffer pH 6. Elution of the heterodimer of interest was performed using 20 mM sodium citrate buffer pH 4 whilst homo-dimeric species were eluted with 0.1 M glycine, pH3.0. Elution was followed by OD reading at 280 nm; fraction containing the hetero-dimer of interest were pooled and neutralized with 0.1 volume of 1M Tris pH 8.0 (Sigma). Supernatant, flow through and elution fractions were analysed under non-reduced conditions by SDS-PAGE (NuPAGE Bis-Tris 4-12% acrylamide, Invitrogen AG, Basel, Switzerland).

Differential Scanning Calorimetry (DSC)

The thermal stabilities of antibodies were compared using calorimetric measurements. Calorimetric measurements were carried out on a VP-DSC differential scanning microcalorimeter (MicroCal-GE Healthcare Europe GmbH, Glattbrugg, Switzerland). The cell volume was 0.128 ml, the heating rate was 1° C./min and the excess pressure was kept at 64 p.s.i. All protein fragments were used at a concentration of 1-0.5 mg/ml in PBS (pH 7.4). The molar heat capacity of each protein was estimated by comparison with duplicate samples containing identical buffer from which the protein had been omitted. The partial molar heat capacities and melting curves were analysed using standard procedures. Thermograms were baseline corrected and concentration normalized before being further analysed using a Non-Two State model in the software Origin v7.0.

The expected melting profiles for the human IgG subclasses are known (Garber E & Demarest S J (2007) Biochem Biophys Res Commun, 355(3): 751-7) and all profiles have been shown to contain three unfolding transitions corresponding to the independent unfolding of the CH2, CH3 and FAB domains. Of the four human IgG subclasses, IGHG1 has the most stable CH3 domain (~85° C.); while other subclasses CH3 domains are less stable, although none are known to melt below 70° C. Similarly, all subclasses are known to have a melting temperature of ~70° C. for the CH2 domain.

Purity Assessment by Capillary Gel Electrophoresis (Example 3.2)
Non-Reduced Sample Preparation 40 µg of desalted protein sample was buffered in SDS sample buffer (Beckman Coulter International S.A., Nyon, Switzerland; IgG Purity Kit, Cat. No: A10663) containing 5 mM Iodoacetamide (Sigma). A 10-kDa internal standard was added to the samples. The sample-mixtures were heated at 70° C. for 10 min.

Capillary Gel Electrophoresis

Following sample preparation, samples were run on a ProteomeLab PA 800 (Beckman Coulter International S.A., Nyon, Switzerland) fitted with a photodiode array detector (DAD) set at 220 nm. Bare-fused silica capillaries of 50 µm ID×30.2 cm (20.2 cm effective length to detector) were used as separation medium. Sample injection and separation were performed at constant voltages of 5 and 15 kV, respectively, with reverse polarity in SDS-molecular weight gel buffer. The data were recorded at a rate of 2 Hz and current was stable during separation. Capillary and samples were thermo-stated at 25° C.

Affinity Measurements by SPR (Example 1)

SPR Testing of FAB Fragments Abrogated for Protein A Binding cDNA encoding the human HER2 extracellular region fused to an IGHG1 Fc fragment was cloned into an expression vector similar to the heavy and light expression vectors described above and transiently transfected in HEK293E cells using the PEI method (see PCT Publication No: WO2012131555). Supernatants were conditioned with 0.1V of 1 M Tris-HCl pH8.0 and the antigen purified by Protein A capture-elution chromatography as described in Example 1. For SPR experiments, a monoclonal mouse anti-human IgG (Fc) antibody sensor chip was used, this allowed for the capture the Fc fused recombinant HER2 antigen in the correct orientation (Human Antibody Capture Kit, catalogue number BR-1008-39, GE Healthcare Europe GmbH). Measurements were recorded on a BIAcore™ 2000 instrument (GE Healthcare Europe GmbH, Glattbrugg, Switzerland). Different dilutions of anti-HER2 FAB (50, 25, 12.5, 6.25, 3.13, 1.57, 0.78, 0.39 nM) were injected over the sensor chip for 4 min at 30 µl/min. For each measurement, after seven minutes of dissociation, a 3M $MgCl_2$ solution was injected for 1 min at 30 µl/min for regeneration. Data (sensorgram: fc2-fc1) were fitted with a 1:1 Langmuir. To account for the experimental variations in captured HER2-Fc at the beginning of each measurement, the Rmax value was set to local in all fits. Measurements were performed in duplicate, and included zero-concentration samples for referencing. Both Chi2 and residual values were used to evaluate the quality of a fit between the experimental data and individual binding models.

Affinity measurements by SPR (Examples 2 & 3)

SPR analysis was used to measure the association and dissociation rate constants for the binding kinetics of the different antibodies (murine and humanized antibodies). The binding kinetics of antibodies were measured on a BIAcore 2000 instrument (BIAcore-GE Healthcare Europe GmbH, Glattbrugg, Switzerland) at room temperature and analysed with the BiaEvaluation software (version 4.1, BIAcore-GE Healthcare Europe GmbH). Measurements were performed on CM5 sensor chips (GE Healthcare Europe GmbH, Cat. No: BR-1000-14) individually coupled with the ligand of interest using a commercial amine coupling kit (GE Healthcare Europe GmbH, Cat. No: BR-1000-50). Protein G ligand was from Pierce (Thermo Fisher Scientific-Perbio Science S.A., Lausanne, Switzerland, Cat. No: 21193).

Data (sensorgram: fc2-fc1) were fitted with a 1:1 Langmuir model with or without mass transfer as indicated. In capture experiments, to account for the experimental variations in at the beginning of each measurement, the Rmax value was set to local in all fits. Dissociation times were of at least 350 seconds. Measurements were performed in triplicate and included zero-concentration samples for referencing. Both Chi2 and residual values were used to evaluate the quality of a fit between the experimental data and individual binding models.

Affinity Measurements on HPB-ALL Cells by FACS

HPB-ALL cells (DSMZ, Braunschweig, Germany, Cat. No: ACC483) were used as CD3 positive cell line for FACS staining. HPB-ALL were maintained in RPMI 1640 supplemented with 10% FCS and 100 U/ml Penicillin and 100 ug/ml streptomycin. 100 µl dilution series of the chimeric OKT3 antibody and humanized variants were incubated with $4 \times 10^5$ HPB-all cells in PBS supplemented with 1% BSA and 0.1% Sodium Azide (referred as FACS buffer) for 45 min on ice. An irrelevant human IgG1 was used as isotype control and the chimeric OKT3 antibody as positive control. After washing, cells were incubated with a 1/200 dilution of anti-Human Fc-PE (EBioscience, Vienna, Austria) for 45 min on ice. Cells were then washed again and resuspended in 200 ul FACS buffer. The relative mean fluorescence of each sample was measured on FACSCalibur (BD Biosciences, Allschwil, Switzerland) Results are summarized in FIG. 9 as the relative staining of HBP-ALL compared to the chimeric OKT3 antibody.

Cell-Lines for In Vitro Assays

Human HER2 Positive Cell Lines

Human cells expressing HER2 antigen have been described in PCT Publication No: WO2010108127. HER2 positive human cell lines as used herein were as follows: BT474 (ATCC-LGL standards; Cat. No: HTB-20)

Culture conditions: RPMI medium supplemented with 10% heat-inactivated FBS, 1% penicillin-streptomycin (Invitrogen AG, Cat. No: 10378-016), 1% sodium pyruvate solution (PAA Laboratories, Pasching, Austria; Cat. No: S11-003), 1% MEM Non-Essential Amino Acids (PAA Laboratories, Cat. No: M11-00dsmz3) and 1% GlutaMAX-1 (Invitrogen AG, Cat. No: 35050-038) in 150 $cm^2$ tissue culture flask (TPP, Trasadingen, Switzerland; Cat. No: 90150). Cells were passaged twice per week.

JIMT-1 (DSMZ, Braunschweig, Germany, Cat. No: ACC589)

Culture conditions: Dulbeco's modified essential medium (DMEM (1×))+GlutaMAX-1 (Invitrogen AG, Cat. No: 31966-012), supplemented with 10% heat-inactivated FBS, 1% penicillin-streptomycin (Invitrogen AG, Cat. No: 10378-016), 1% sodium pyruvate solution (PAA Laboratories, Cat. No: S11-003), 1% MEM Non-Essential Amino Acids (PAA Laboratories, Cat. No: M11-003) and 1% GlutaMAX-1 (Invitrogen AG, Cat. No: 35050-038). Cells were passaged 2-3 times per week.

MDA-MB-231 (ATCC-LGL standards; Cat. No: HTB-26).

Culture conditions: same culture conditions as JIMT-1.

HT-1080 (ATCC-LGL standards; Cat. No: CCL-121).

Culture conditions: HT1080 cells are cultured in EMEM medium supplemented with 10% heat-inactivated FBS, 1% penicillin-streptomycin (Invitrogen AG, Cat. No: 10378-016), and 1% glutamine (Invitrogen AG, Cat. No: 25030-024). The cells are cultured at split three times a week (1 in 6 dilution).

NCI-N87 (ATCC-LGL standards; Cat. No: CRL-5822).

Culture conditions: NCI-N87 cells are cultured in RPMI 1640 medium with 10% heat-inactivated FBS, 1% penicillin-streptomycin (Invitrogen AG, Cat. No: 10378-016), 1% sodium pyruvate solution (PAA Laboratories, Pasching, Austria; Cat. No: S11-003), 1% MEM Non-Essential Amino Acids (PAA Laboratories, Cat. No: M11-00dsmz3), and 1% glutamine (Invitrogen AG, Cat. No: 25030-024). The cells are split twice a week (1 in 3 dilution).

Human CD38 Positive Cell Lines

Human cells expressing CD38 antigen have been described in PCT Publication Nos: WO2005103083, WO2008047242, WO2011154453 and WO2012092612. CD38 positive human cell lines as used herein were as follows: Stable recombinant CHO[CD38] cells A gene coding for human CD38 was ordered at Source Biosciences (Berlin, Germany, Cat.-No.: IRAU37D11, 4309086). Human CD38 was amplified using primers adding a kozak sequence, a start codon followed by a signal peptide (murine V leader) to the 5' end and a NheI restriction site to the 3' end. The amplicon was cut using NheI and HindIII and cloned into the expression cassette of pT1, a pcDNA3.1 (Invitrogen AG) derived vector developed in-house. The expression cassette of pT1 links the expression of the gene of interest with expression of GFP and PAC (the gene for puromycin resistance) using two IRES (internal ribosome entry sites) on a polycistronic mRNA. A midiprep of the plasmid was prepared and the cloned CD38 open reading frame was confirmed by DNA sequencing. Suspension CHO-S cells (Invitrogen AG) were transfected using polyethyleneimine (JetPEI®, Polyplus-transfection, Illkirch, France) in 50 ml bioreactor format (TubeSpin 50 bioreactors, TPP, Trasadingen, Switzerland). For this purpose, exponential growing cells were seeded in OptiMEM medium (Invitrogen AG, Cat. No.: 31985-047). A JetPEI®:DNA complex was added to the cells. After 5 h incubation of the cells with the JetPEI®:DNA complex at 37° C. under shaking (200 RPM) for endocytosis, one volume of culture medium PowerCHO2 (Lonza, distributor RUWAG Lifescience, Bettlach. Switzerland, Cat. No:BE12-771Q) supplemented with 4 mM Gln was added to the cell suspension. The cells were then incubated on a shaken platform at 37° C., 5% CO2 and 80% humidity. One day after transfection the cells were seeded in 96 well plates at different concentrations in selective medium containing puromycin (Sigma, Cat. No: P8833-25 mg). After approximately 14 days of selection under static conditions, 46 high GFP expressing cell pools were expanded as suspension cultures using TubeSpin 50 bioreactors. Once successfully adapted to suspension, the cells were analysed for CD38 by FACS. Stable CHO[CD38] clones with a homogenous CD38 staining profile were selected and used herein.

Other CD38 positive cell lines included:
NCI-H929 (ATCC-LGL standards; Cat. No: CRL-9068).
Namalwa (ATCC-LGL standards; Cat. No: CRL-1432)
U266 (ATCC-LGL standards; Cat. No: TIB-196)
RPMI 8226 (ATCC-LGL standards; Cat. No: CCL-155)
Culture conditions: RPMI 1640 medium supplemented with 10% heat-inactivated FBS, 1% penicillin-streptomycin (Invitrogen AG) and 1% GlutaMAX-1 (Invitrogen AG)
Raji (ATCC-LGL standards; Cat. No: CCL-86)
Daudi (ATCC-LGL standards; Cat. No: CCL-213)
Human OX40 Positive Cell Lines Human cells expressing OX40 antigen have been described in PCT Publication No: WO2013008171.

Peripheral blood mononuclear cells (PBMCs) and HBP-ALL are examples of human OX40 positive cell lines.

Stable recombinant CHO[OX40] cells were used herein. A recombinant CHO cell line carrying a synthetic cDNA coding for human OX40 was engineered using a similar protocol to that of the stable recombinant CHO[CD38] cell line described above.
Human CD20 Positive Cell Lines Human cells expressing CD20 antigen have been described in PCT Publications No: WO2010095031. An example of CD20+ cancer cells is the Daudi cancer cell-line (ATCC-LGL standards; Cat. No: CCL-213), these B lymphoblast cancer cells are cultured in RPMI 1640 medium (Sigma) supplemented with 20% FBS and 1% P/S; 1% L-Glut; 1% Na-Pyr and 1% NEAA. The cells are cultured at 37° C. with 5% CO2 supplementation.

Human EGFR Positive Cell Lines

Human cells expressing EGFR antigen have been described in PCT Publication No: WO2010108127. An example of EGFR+ cancer cells is the HT-29 cancer cell-line (ATCC-LGL standards; Cat. No: HTB-38), these colorectal cancer cells are cultured are cultured in McCoy's 5A medium (Sigma) supplemented with 10% FBS and 1% P/S; 1% L-Glut; 1% Na-Pyr and 1% NEAA. The cells are cultured at 37° C. with 5% CO2 supplementation.
Human CD19 Positive Cell Lines Human cells expressing CD19 antigen have been described in PCT Publication No: WO2010/095031. Namalwa (ATCC-LGL standards; Cat. No: CRL-1432) and Raji (ATCC-LGL standards; Cat. No: CCL-86) are examples of human CD20 positive cell lines.
Human Membrane IgE Positive Cell Lines PCT Publication No: WO2010/033736 on page 71 describes a method to class switch human PBMCs into IgE producing B cells by adding interleukin-4 (IL-4) and anti-CD40 antibody.
Recombinant Target Antigens
Human CD3 Gamma-Epsilon-Fc Fusion Protein A cDNA encoding the human CD3 gamma extracellular region (UniProt accession No: P09693 residues 23-103 (SEQ ID NO: 184); UniProt Consortium (2013) Nucleic Acids Res., 41(Database issue): D43-7) fused to the human CD3 epsilon extracellular region (UniProt accession No: P07766, residues 22-118 (SEQ ID NO: 185)) by a 26-residue peptide linker (sequence: GSADDAKKDAAKKDDAK-KDDAKDGS; SEQ ID NO: 186) was first synthetized by GENEART AG (Regensburg, Germany). This synthetic gene was fused to a human IgG1 Fc portion using standard overlap PCR techniques and a human IgG1 Fc cDNA template also obtain from Geneart AG. The resulting cDNA was cloned in the modified pcDNA3.1 plasmid mentioned above.

For transient expression of the CD3 gamma-epsilon-Fc protein (SEQ ID NO: 187), the recombinant vector was transfected into suspension-adapted HEK-EBNA cells (ATCC-CRL-10852) using Polyethyleneimine (PEI) as described above. The CD3 gamma-epsilon-Fc construct was then purified from cell-free supernatant using recombinant Streamline rProtein A media (GE Healthcare Europe GmbH, Glattbrugg, Switzerland) and used for further analysis.
Human and Cynomolgus Monkey CD3 Epsilon 1-26_Fc Fusion Proteins A cDNA encoding the human CD3 epsilon peptide 1-26 (UniProt accession No: P07766, amino acids 23-48, SEQ ID NO: 188) and a cDNA encoding the cynomolgus CD3 epsilon peptide 1-26 (UniProt accession No: Q95L15, amino acids 22-47, SEQ ID NO: 189) were PCR amplified from synthetic cDNAs obtained from GENEART A.G. for the human and cynomolgus monkey CD3 epsilon extracellular regions, respectively. The amplified products were subsequently fused to a human IgG1 Fc portion using standard overlap PCR techniques. The human IgG1 Fc cDNA template was obtained from Geneart AG. The resulting cDNA were cloned in the modified pcDNA3.1 plasmid mentioned above.

For transient expression of human and cynomolgus CD3 epsilon constructs (SEQ ID NO: 190 and 191, respectively), the recombinant vectors were transfected into suspension-adapted HEK-EBNA cells (ATCC-CRL-10852) using Polyethyleneimine (PEI) as described above. The CD3 epsilon fusion constructs were then purified from cell-free supernatant using recombinant Streamline rProtein A media (GE Healthcare Europe GmbH, Glattbrugg, Switzerland) and used for further analysis. These two fusion proteins are referred herein as the human and cynomolgus monkey CD3 epsilon 1-26_Fc fusion proteins.

Human HER2 Extracellular Region

Preparations of HER2 soluble extracellular region have been described in PCT Publication No: WO2012131555. Human HER2 soluble extracellular region fused to a polyhistidine tag (referred herein as HER2-his) or fused to a human IgG1 Fc region (referred herein as HER2-Fc) were prepared.

Human and Cynomolgus Monkey CD38 Extracellular Regions

A cDNA for human CD38 was obtained from Source Biosciences (Erwin-Negelein-Haus, Germany, Cat. No.: IRAU37D11, 4309086), its extracellular region (UniProt accession No: P28907 residues 43-300) was PCR amplified and cloned into an in-house expression vector derived from pcDNA3.1 (Invitrogen AG). This expression vector encompassed a kozak sequence and a start codon followed by the murine VJ2C leader peptide to the 5' end and a 6-His-tag to the 3' end of its multiple cloning site. The soluble extracellular region of human CD38 fused to a 6-His-tag (SEQ ID NO: 192) was expressed and purified as follows: one volume of RPMI 1640 medium (PAA Laboratories, Cat. No: E15-039) containing HEK cells, 0.1% pluronic acid (Invitrogen AG), expression vector and polyethylenimine (JetPEI®, Polyplus-transfection, Illkirch, France) was incubated in a shaker flask at 37° C., 5% $CO_2$ and 80% humidity. One volume of ExCell293 medium supplemented with 6 mM glutamine was added to the mixture after 4 hours and incubation continued further for a total of 5 days. Post production, cell-free supernatant was prepared by centrifugation and filtrated using 0.2 µm filters, pH was adjusted at 7.4 (4° C.) using Tris 1 M pH 8.7. Ni-Sepharose Excell beads (GE Healthcare, Cat. No: 17-3712-03) were added to the solution and incubated overnight at 4° C. under agitation. The solution was loaded on an Econo-Column (Bio-Rad Laboratories AG, Reinach, Switzerland, Cat. No: 737-4252) for gravity-flow purification. The beads were washed in PBS (2×), 20 mM imidazole and the protein was eluted in PBS, 500 mM Imidazole. Eluted fractions were pooled and buffer exchanged for PBS with two dialysis steps at 4° C. The purified human CD38 extracellular region was filtrated using 0.22 µm syringe filters. Using the methods as described above the soluble extracellular region of cynomolgus monkey CD38 antigen fused to a 6-His-tag (SEQ ID NO: 193) was cloned, expressed and purified.

Human OX40 Extracellular Region

A method to prepare the soluble extracellular region of human OX40 has been described in PCT Publication No: WO2013008171.

Human EGFR Extracellular Region

An example of EGFR soluble extracellular region antigen preparation has been described in PCT Publication No: WO2012131555.

In Vitro T Cell Redirection Killing Assay

Preparation of Peripheral Blood Mononuclear Cells

To produce peripheral blood mononuclear cells (PBMCs), blood filters containing human leukocytes were collected from the Blood Collection Centre in La Chaux-de-Fonds, Switzerland (Centre de Transfusion Sanguine et Laboratoire de Sérologie, rue Sophie-Mairet 29, CH-2300). Cells were removed from the filters by back-flushing with 60 ml of PBS containing 10 U/ml of liquemin (Drossapharm AG, Lucern, Switzerland). PBMCs were then purified with 50 mL Blood-Sep-Filter Tubes (Brunschwig, Basel, Switzerland) following manufacturer's instructions. Tubes were centrifuged for 20 min at 800 g at room temperature (without brake) and the cells were collected from the interface. Cells were washed 3× with Roswell Park Memorial Institute (RPMI, PAA Laboratories, Pasching, Austria) medium without FBS or phosphate buffered Saline (PBS). PBMCs were resuspended at 10e6 cells/mL in RDL medium (RPMI supplemented with 10% heat inactivated Fetal bovine serum (FBS) and penicillin/streptomycin) and were cultured overnight at 37° C. in a 5% $CO_2$ incubator prior to the assay.

T Cell Preparations

T cell purification was performed directly after the PBMC isolation using pan-T cell isolation kit II (Myltenyi Biotec GmbH, Bergisch Gladbach, Germany, Cat. No: 130-091-156) following manufacturer's instructions. After purification, T cells were resuspended at 10e6 cells/mL in RDL medium and cultured overnight at 37° C. in a 5% $CO_2$ incubator prior assay.

Assay Readouts

Two different readouts which gave highly comparable results were used to quantify the redirected killing. A flow cytometry method, referred herein as RDL-FACS method, based on fluorescence-cytometry as described in Schlereth B et al. ((2005) Cancer Res, 65: 2882-2889), Moore P A et al. ((2011) Blood, 117(17): 4542-51) and Friedrich M et al. ((2012) Mol Cancer Ther, 11: 2664-2673). Target cells were harvested, counted, washed once and resuspended at 5×10e6 cells/mL in PBS+1 µM Carboxyfluorescein succinimidyl ester (CFSE, Sigma). Cells were incubated 15 min at 37° C. with gentle agitation every 5 min. CFSE loaded cells were washed 3× with RDL medium and resuspended at 2×10e5 cells/mL in RDL medium. PBMCs were harvested, counted and resuspended at 2×10e6 cells/mL in RDL medium. Antibodies serial dilutions (3× solutions) were prepared in RDL medium. Target cells (50 µl/well), T cells (50 µl/well) and 3× antibody solutions (50 µl/well) were distributed in flat-bottom 96-well plate (TPP, Trasadingen, Switzerland). The effector:target ratio was 10:1. The plates were incubated for 48 h in a 5% $CO_2$ incubator at 37° C. After incubation the plates were centrifuged for 3 min at 300 g, the supernatants were discarded by flicking the plates. The plates were washed once with 200 µl of PBS, centrifuged again and the PBS was discarded. A pre-warmed solution of accutase (Invitrogen AG) was added and the plates were incubated 10 min at 37° C. The detached adherent cells were resuspended by pipetting up and down after addition of 100 µL of RDL medium. The solution was transferred into a U-bottom 96-well plate (TPP). The U-bottom plates were centrifuged for 3 min at 300 g, the supernatants were discarded and the cells were resuspended in 200 µl of cold FACS buffer (PBS+2% FBS+10% Versene) supplemented with 7-AAD (Becton Dickinson AG, Allschwil, Switzerland) at a 1/40 dilution. The plates were immediately acquired on a Guava easyCyte™ Flow Cytometer (Millipore AG, Zug, Switzerland). For each well, the absolute number of living target cells was determined by gating on CFSE positive 7ADD negative population using Flowjo® software (Miltenyi Biotec GmbH, Bergisch Gladbach, Germany). The percentage of specific cytotoxicity for each sample was determined using the condition in which only target cells were incubated as baseline. The $EC_{50}$ values were determined using non-linear variable slope regression method with Prism software (GraphPad software, La Jolla, Calif., USA). The percentage of specific re-directed lysis (RDL) was calculated by subtracting the percentage of specific cytotoxicity of the condition without antibody to the conditions where a test antibody was added.

A cell viability method, referred herein as RDL-MTS method based on a colorimetric method to assess cell viability as described in in Bühler P et al. ((2008) Cancer Immunol Immunother, 57: 43-52, Labrijn A F et al. ((2013) Proc Natl Acad Sci USA, 110(13): 5145-50) and PCT Publication No: WO2012143524. Target cells were harvested, counted, washed once and resuspended at 2×10e5 cells/ml in RDL medium. PBMCs were harvested, counted and resuspended at 2×10e6 cells/mL in RDL medium. Antibodies serial dilutions (3× solutions) were prepared in RDL medium. Target cells (50 µl/well), T cells (50 µl/well) and 3× antibody solutions (50 µl/well) were distributed in flat-bottom 96-well plate (TPP). The effector:target ratio was 10:1. The plates were incubated for 48 h in a 5% $CO_2$ incubator at 37° C. After incubation the supernatants were discarded and the plates were washed 3 times with 200 µL of PBS to remove the PBMCs and 100 µl of RDL medium was then added to each well. The readout was done using CellTiter 96® kit (Promega AG, Dübendorf, Switzerland) according to manufacturer's instructions. Briefly, 10-20 µl of MTS reagent was added to each well and the plates were incubated 2-6 h in a 5% $CO_2$ incubator at 37° C. The 490 nm absorbance was then read on a BioTek synergy plate reader (BioTek AG, Luzern, Switzerland). The percentage of specific killing was calculated using this formula: Specific killing=100×[(SD−Sp)/(SD−MD)]. SD is the absorbance measured in spontaneous death condition where target cells were incubated alone. Sp is the absorbance measured in each test condition (target cells+PBMCs+antibody). MD is the absorbance measured in the maximum death condition in which target cells were lysed by 3 freeze and thaw cycles. The percentage of specific redirected lysis (RDL) was calculated by subtracting the percentage specific cytotoxicity of the condition without antibody to the conditions where a test antibody was added. The $EC_{50}$ values were determined using nonlinear variable slope regression method with Prism software (GraphPad software).

Xenograft Model
JIMT-1 Xenografts
Cells Lines and Reagents

Breast carcinoma JIMT-1 cell line was obtained from DSMZ (Cat. No: ACC589). Cells were maintained in DMEM (IX) with GlutaMAX™-1 (Invitrogen AG, Cat. No: 31966-021) supplemented with 10% heat-inactivated fetal bovine serum (FBS) (AMIMED, London, UK, Cat. No: Z10834P), 1% penicillin-streptomycin (Invitrogen AG, Cat. No: 10378-016), 1% sodium pyruvate solution (PAA Laboratories, Cat. No: S11-003), 1% MEM Non-Essential Amino Acids (PAA Laboratories, Cat. No: M11-003) and 1% GlutaMAX™-1 (Invitrogen AG, Cat. No: 35050-038). Cells were split twice a week with StemPro Accutase (Invitrogen AG, Cat. No: A11105-01).

Peripheral blood mononuclear cells (PMBC) were collected from blood filters containing human leukocytes from the Blood Collection Centre in La Chaux-de-Fonds, Switzerland (Centre de Transfusion Sanguine et Laboratoire de Serologie, rue Sophie-Mairet 29, CH-2300). Cells were removed from the filters by back flushing with 60 ml of PBS containing 10 U/mL of liquemin (Drossapharm AG, Lucern, Switzerland). PBMCs were then isolated with 50 ml BloodSep-Filter Tubes (Brunschwig, Basel, Switzerland) following manufacturer's instructions: tubes were centrifuged 20 min at 800 g at RT (without brake) and the cells were collected from the interface. Cells were washed 3 times with Roswell Park Memorial Institute medium without FBS (RPMI, Invitrogen AG, Cat. No: 21875-091). PBMCs were resuspended at 10e6 cells/ml in RPMI medium supplemented with 10% FBS (AMIMED), 1% penicillin-streptomycin (Invitrogen AG) and were cultured overnight at 37° C. under 5% $CO_2$. Target cells were harvested, counted, washed once and resuspended at 5×10e6 cells/ml in PBS.

Mice and Experimental Conditions

In vivo experiments were performed in 5-week-old immunodeficient NOD.CB17/AlhnRj-Prkdcscid/Rj (NOD/SCID) female mice characterized by T cell, B cell and natural killer cell deficiency (Janvier Labs, St Berthevin, France). The mice were maintained under sterile and standardized environmental conditions in standard rodent micro-isolator cages (20+/−1° C. room temperature, 50±10% relative humidity, 12 hours light dark rhythm). Mice received irradiated food, bedding and 0.22 µm-filtered drinking water. All experiments were done according to the Swiss Animal Protection Law with permission from the responsible cantonal authorities (Neuchatel Canton, Switzerland). In compliance with the Animal Protection Law, mice had to be euthanized when tumor volumes exceeded 2000 $mm^3$. Statistical analysis of the mean tumor volume of the corresponding treatment groups versus the vehicle control group was done by ANOVA one way and Bonferroni parametric tests.

All mice were depilated before engraftment with VEET cream (Reckitt Benckiser AG, Wallisellen, Switzerland) on the right flank. Photographs and weight measurements of mice were performed on the day of engraftment and later once a week. For each animal, 5×10e6 human PBMC were mixed with 5×10e6 JIMT-1 breast carcinoma cells in a final volume of 0.2 ml PBS. Four different PBMC donors were included. The PBMC/JIMT-1 mixture was subcutaneously injected into the right flank of each NOD/SCID mouse. A control group with 5×10e6 JIMT-1 breast carcinoma cells in a final volume of 0.2 ml PBS without any human PBMC was included. For each group of ten JIMT-1/PBMC engrafted animals (one group per PBMC donor), five animals were intravenously treated with HER2/CD3-1 bispecific antibody at 0.05 mg/kg 3 hours after engraftment using a volume of 100.1. Treatment was repeated 3 times per week, every two days, during two weeks. Tumors were measured twice a week with a caliper in two perpendicular dimensions and tumor volumes were calculated according to the following formula: tumor volume=[(width2×length)/2].

Example 1

Figure 3:
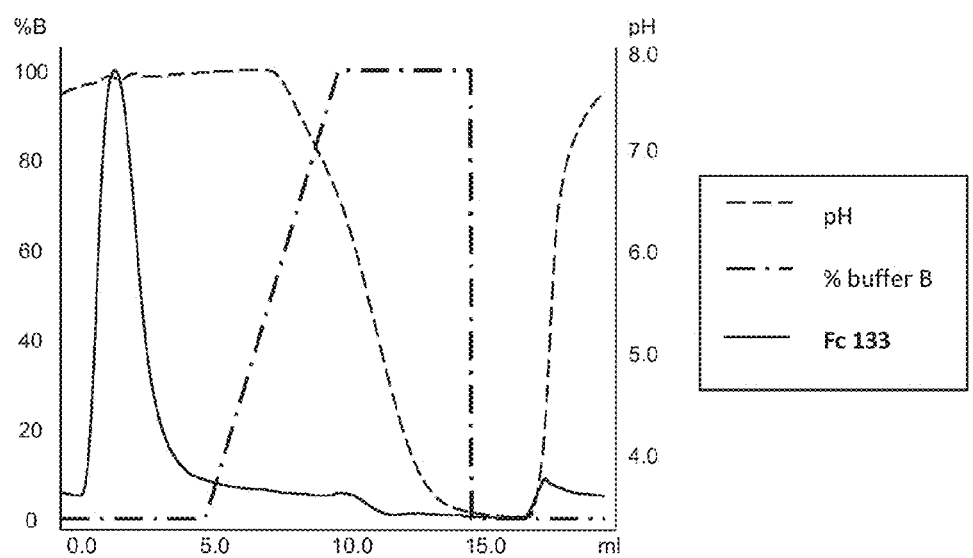
FIG. 3: Protein A gradient mode chromatography traces for Fc 133 (HiTrap™ MabSelect SuRe™ Protein A column). Plots of absorbance at 280 nm vs. total volume of mobile phase are shown as solid line. Plots of mobile phase pH and percentage of eluent buffer (B) present in mobile phase are shown as dashed and dotted-dashed lines, respectively.
Figure 4A:
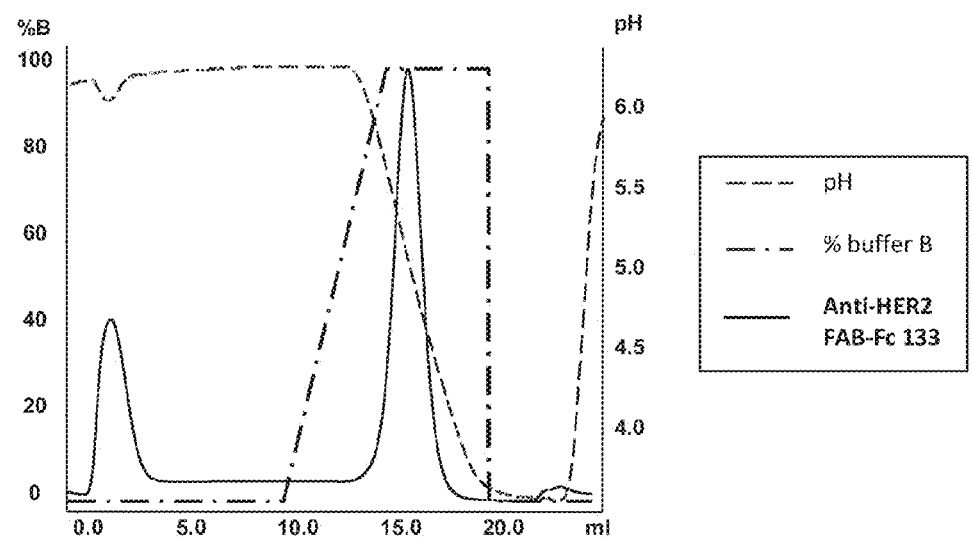
FIG. 4A-C: Protein A gradient mode chromatography traces. Plots of absorbance at 280 nm vs. total volume of mobile phase are shown as solid line. Plots of mobile phase pH and percentage of eluent buffer (B) present in mobile phase are shown as dashed and dotted-dashed lines, respectively.

Determination of Mutations that Reduce or Abrogate Binding to Protein A in VH3 Subclass Methods to abrogate Protein A binding in immunoglobulin constant region are known (Lindhofer H. et al., (1995) J Immunol, 155(1): 219-225; U.S. Pat. No. 6,551,592; Jendeberg L. et al., (1997) J Immunol Methods, 201(1): 25-34; PCT Publication No: WO2010151792). To assess the use of Protein A abrogating methods in full-length homo-dimeric immunoglobulins, an anti-HER2 homo-dimeric immunoglobulin based on a mixed IGHG1-IGHG3 Fc format and the corresponding Fc 133 control fragment were prepared. The anti-HER2 homo-dimeric immunoglobulin was formatted similarly to a naturally occurring antibody and consisted of a FAB fragment with anti-HER2 specificity fused to a Fc 133 fragment (a Fc sequence originating from the naturally occurring human IGHG3 isotype wherein the hinge sequence was substituted for the entire hinge sequence from the naturally occurring human IGHG1 isotype, abbreviated Fc 133 with SEQ ID NO:1—wherein the numerals in the name correspond to the immunoglobulin gamma isotype subclass of each domain in the order of: hinge/CH2/CH3; the corresponding full-length anti-HER2 immunoglobulin being referred herein as anti-HER2 FAB-Fc 133; heavy chain with SEQ ID NO: 2 and light chain with SEQ ID NO: 3). Post transfection, the anti-HER2 FAB-Fc 133 homo-dimer and Fc 133 fragment were assayed for Protein A binding by gradient chromatography according to the protocol described in the Materials and Methods Section. As shown in FIG. 3 and FIG. 4A, the Fc 133 fragment did not bind the commercial MabSelect SuRe™ Protein A resin (GE Healthcare Europe GmbH) while the anti-HER2 FAB-Fc 133 homo-dimer was able to bind.

Figure 4B:
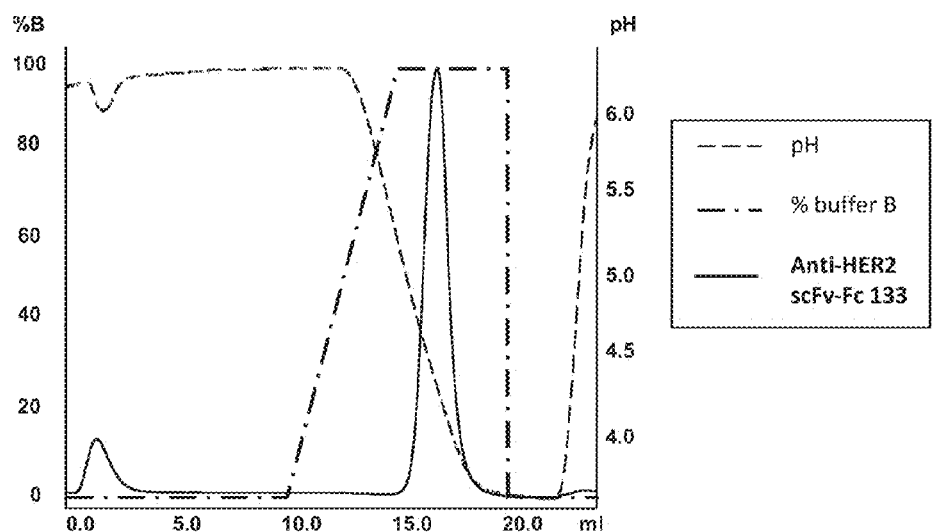

To assess the contribution of the FAB constant domains, the anti-HER2 homo-dimer described above was reformatted as an anti-HER2 scFv-Fc molecule wherein the scFv unit consisted of the parent immunoglobulin variable domains fused by a 15 amino-acid linker (abbreviated herein as anti-HER2 scFv-Fc 133; heavy chain with SEQ ID NO: 4). The resulting anti-HER2 scFv-Fc 133 homo-dimer was therefore identical to the parent anti-HER2 FAB-Fc 133 homo-dimeric immunoglobulin but lacked the CH1 and CK constant domains. As shown in FIG. 4B, the scFv-Fc 133 homo-dimer exhibited Protein A binding as observed with the parent anti-HER2 homo-dimeric immunoglobulin. This finding led to the conclusion that the variable domains of the anti-HER2 FAB fragment were responsible for hampering the efficacy of the methods abrogating Protein A binding in the Fc portion of homo-dimeric immunoglobulins. More importantly, it was concluded that Protein A binding within variable domains of homo-dimeric immunoglobulins will prevent the preparation of hetero-dimeric immunoglobulins based on Protein A differential purification techniques.

All five domains of Protein A are known to bind the variable heavy chain domains from the VH3 variable domain subclass (Jansson B et al., (1998) FEMS Immunol. Med. Microbiol., 20(1): 69-78), a feature which is known to hamper the preparation of VH3 based FAB fragments following papain digestion of whole antibody molecules, since Protein A binds both VH3 based FAB and Fc fragments. The heavy chain variable domain found in the homo-dimeric anti-HER2 immunoglobulin or its scFv-Fc version belongs to the VH3-23 subclass, and explains why these homo-dimeric molecules bound Protein A in spite of having no Protein A binding site within their engineered Fc regions.

VH3 based immunoglobulins or fragments thereof are of major importance to the biotechnology industry. VH3 based molecules have been extensively developed since their ability to bind Protein A facilitates their functional pre-screening, and as such many synthetic or donor based phage display libraries or transgenic animal technologies used for antibody discovery are based on the VH3 domain subclass. In addition VH3 based molecules are often selected for their good expression and stability over other known heavy chain variable domain subclasses. A recombinant version of Protein A which does not bind VH3 based FAB fragments has been developed and commercialized by GE Healthcare under the trade name MabSelect SuRe™.

Since the MabSelect SuRe™ resin was used herein for the Protein A binding assessment of the two homo-dimeric anti-HER2 immunoglobulins discussed above, it was concluded that the MabSelect SuRe™ resin was unsuitable for the preparation of hetero-dimeric immunoglobulins having at least one VH3 variable domain when using Protein A differential purification techniques—since homo-dimeric species having no Protein A binding in their Fc regions will still bind Protein A through their VH3 domains.

To investigate substitutions that would abrogate or reduce Protein A binding from VH3 based homo-dimeric immuno-globulins or fragments thereof, VH3 based FAB variants will need to be assayed for Protein A binding. Although the MabSelect SuRe™ resin type is known to lack VH3 domain subclass binding, another commercial Protein A resin known as MabSelect™ does bind the VH3 domain subclass (also from GE healthcare) and was selected to analyse VH3 based FAB variants for Protein A binding.

Figure 4C:
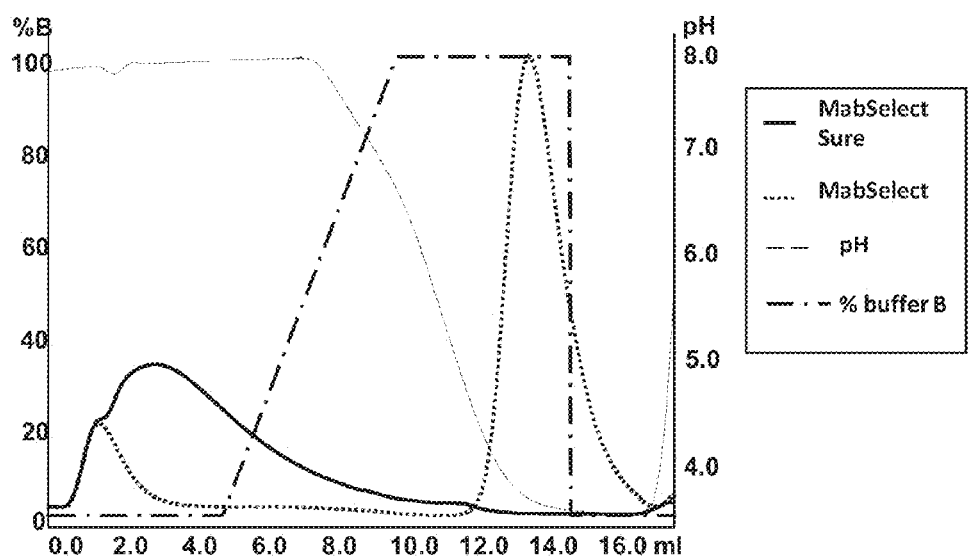
Figure 6A:
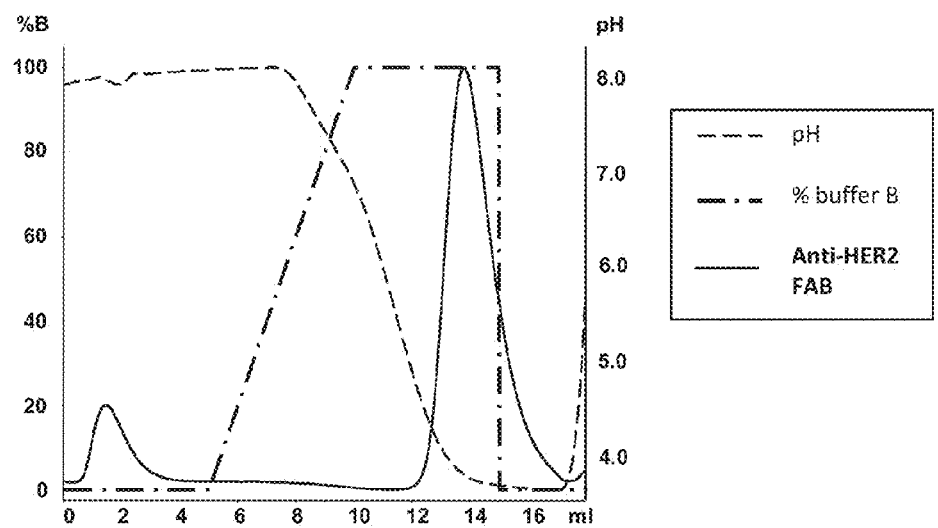
FIG. 6A-I: Protein A gradient mode chromatography traces (HiTrap™ MabSelect™ Protein A column). Plots of absorbance at 280 nm vs. total volume of mobile phase are shown as solid line. Plots of mobile phase pH and percentage of eluent buffer (B) present in mobile phase are shown as dashed and dotted-dashed lines, respectively.
Figure 6B:
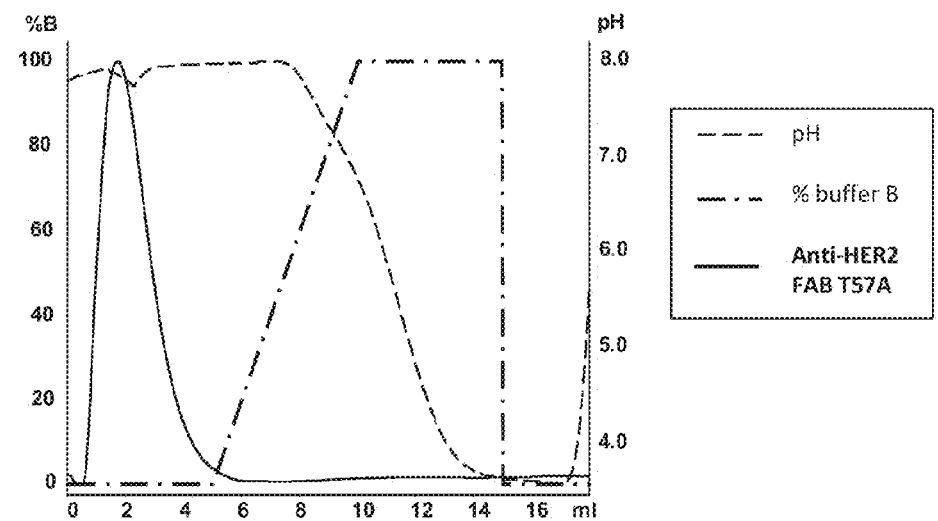
Figure 6C:
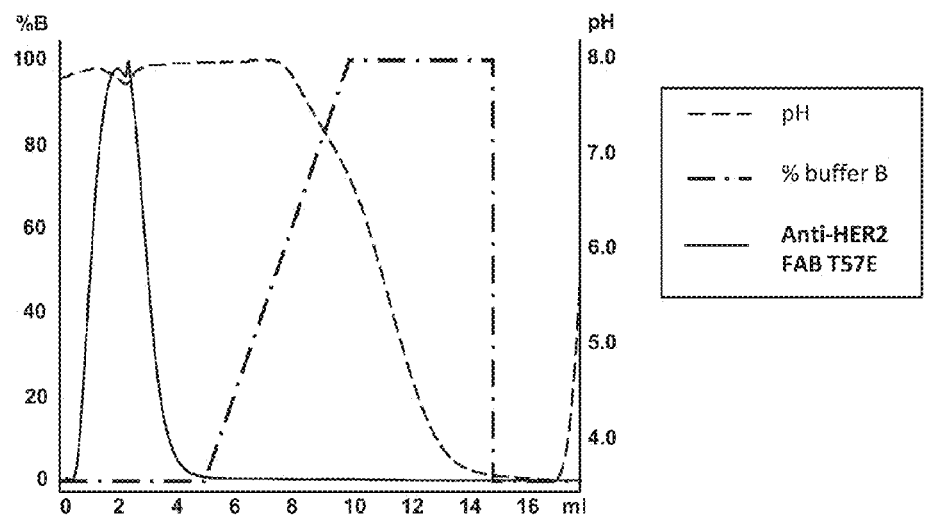
Figure 6D:
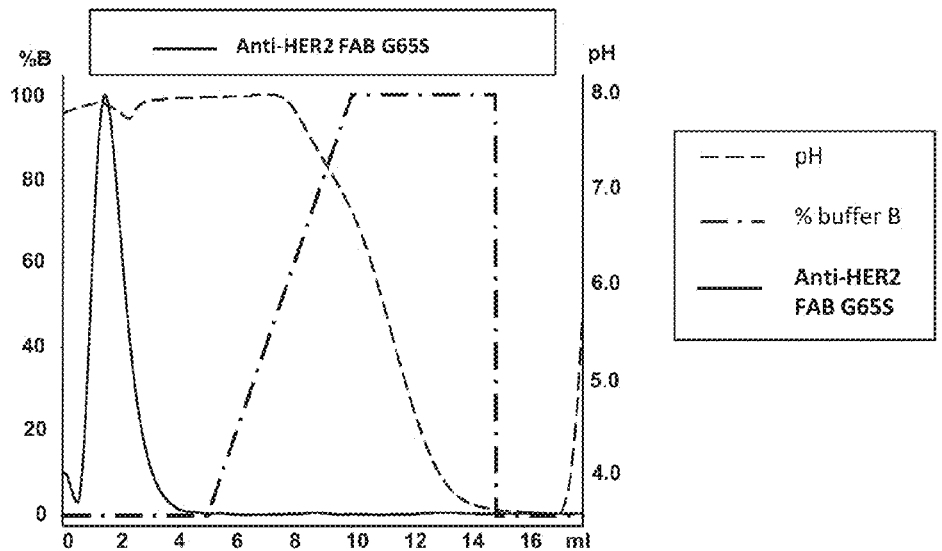
Figure 6E:
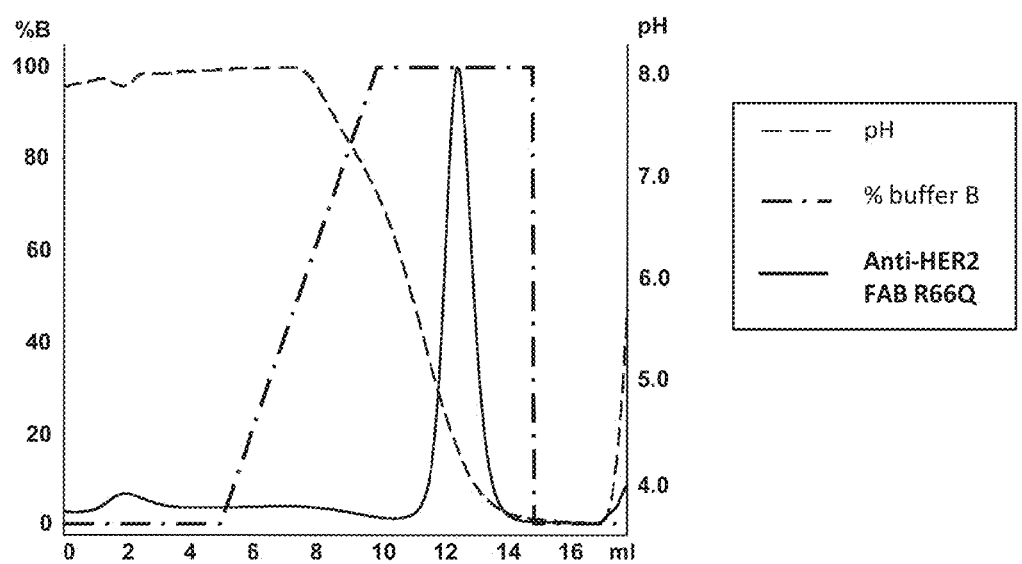
Figure 6F:
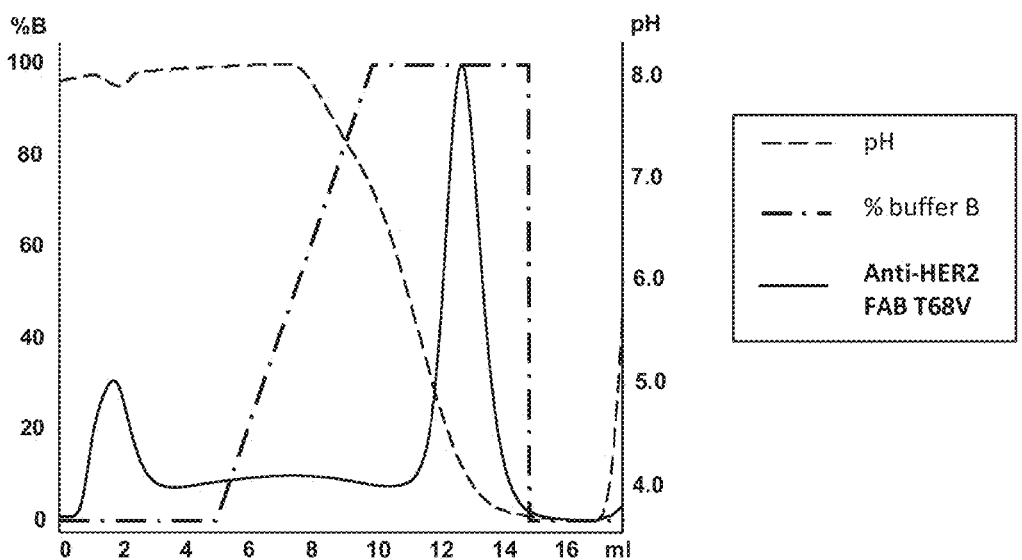
Figure 6G:
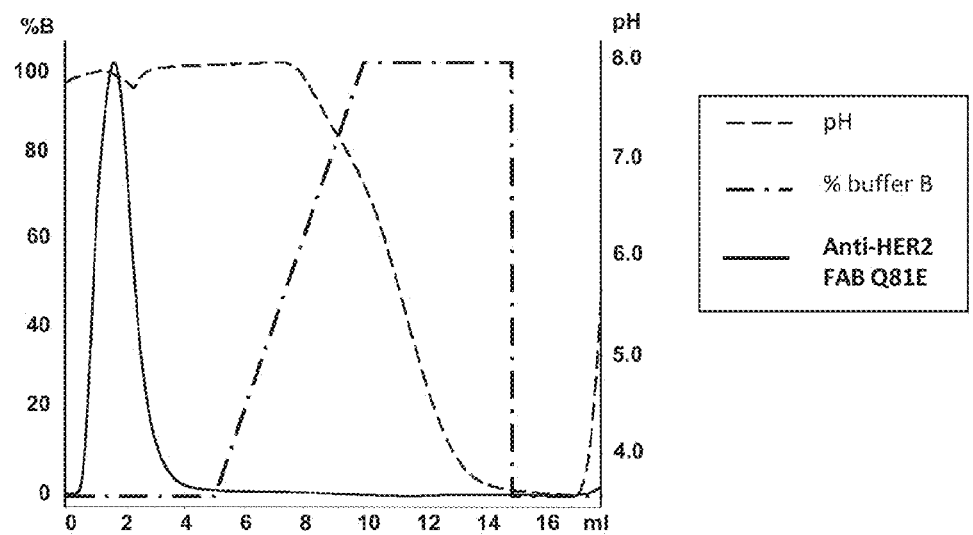
Figure 6H:
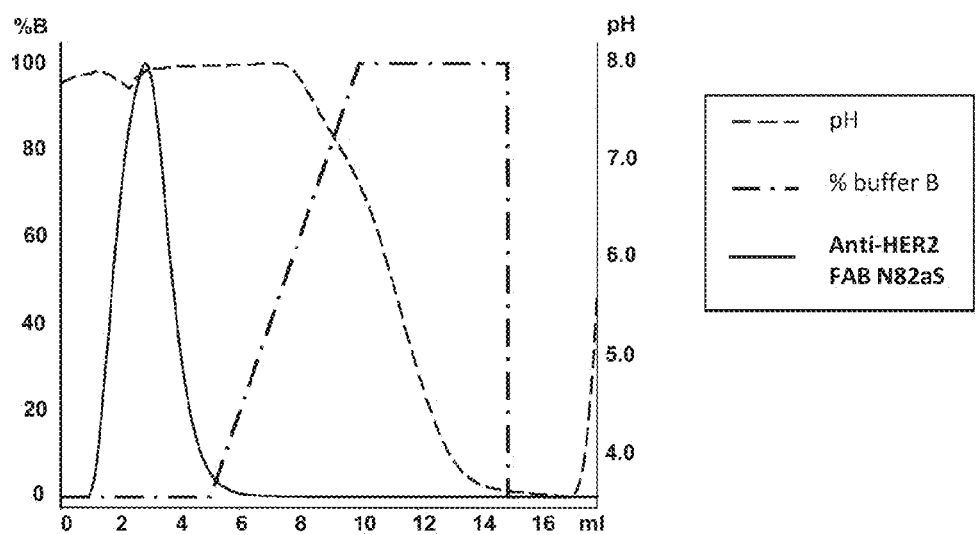
Figures 6I, 7:
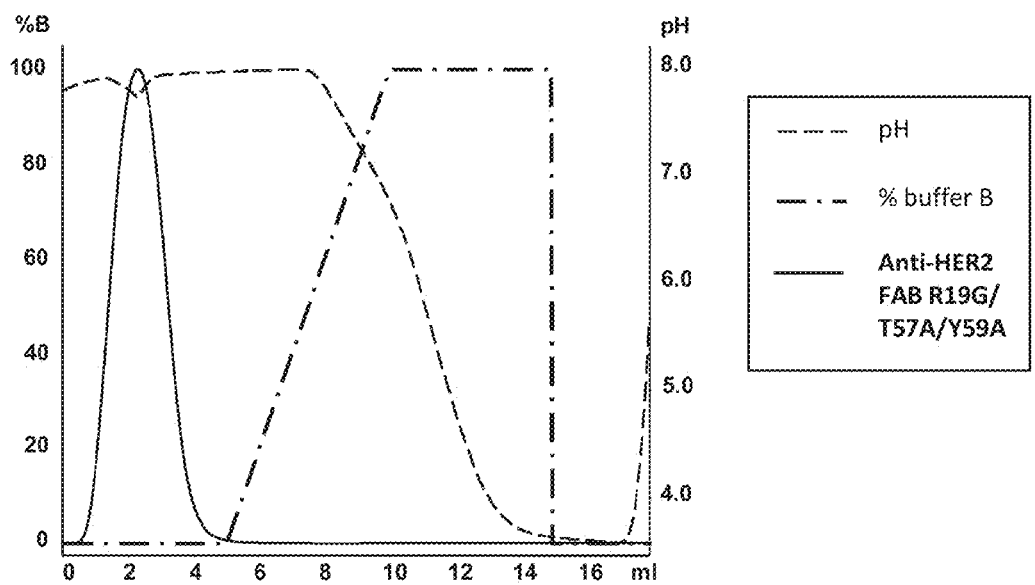
FIG. 7: Equilibrium dissociation constants (KD) of selected anti-HER2 FAB variants for the HER2 antigen.
Figure 8A:
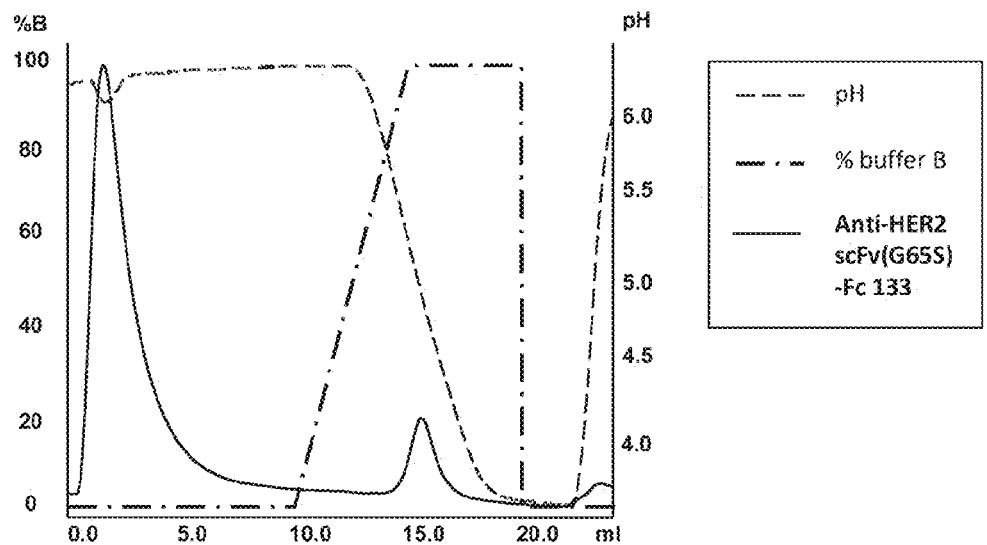
FIG. 8A-D: Protein A gradient mode chromatography traces (HiTrap™ MabSelect SuRe™ Protein A column). Plots of absorbance at 280 nm vs. total volume of mobile phase are shown as solid line. Plots of mobile phase pH and percentage of eluent buffer (B) present in mobile phase are shown as dashed and dotted-dashed lines, respectively.
Figure 8B:
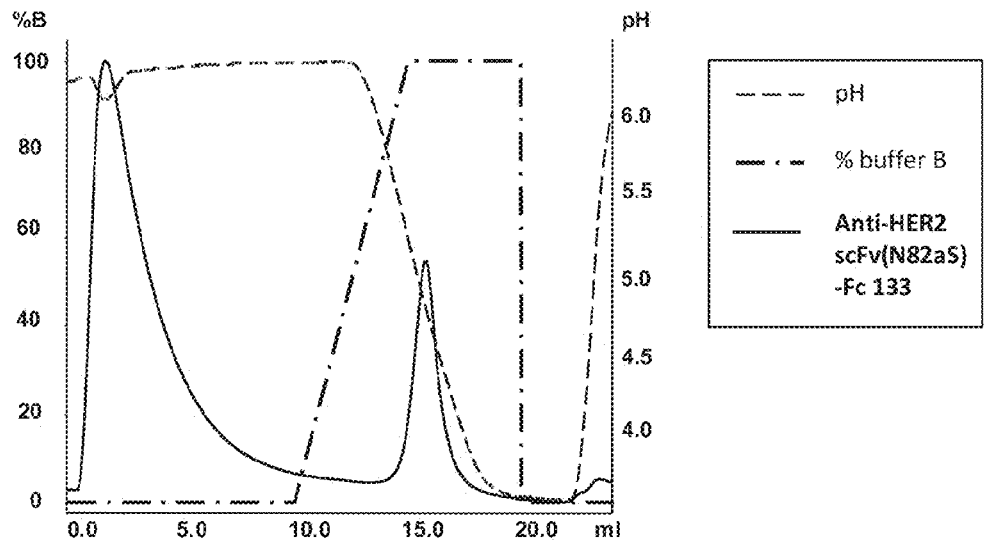
Figure 8C:
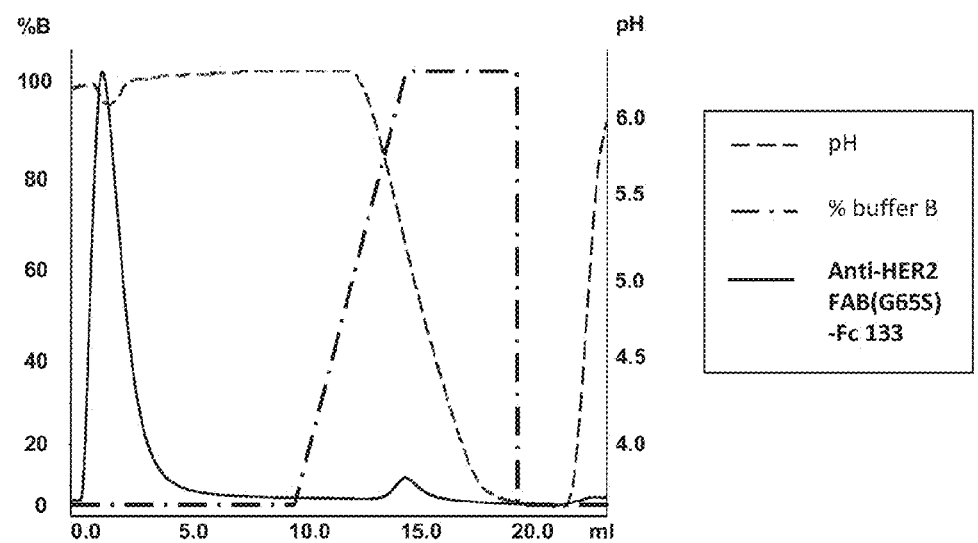
Figure 8D:
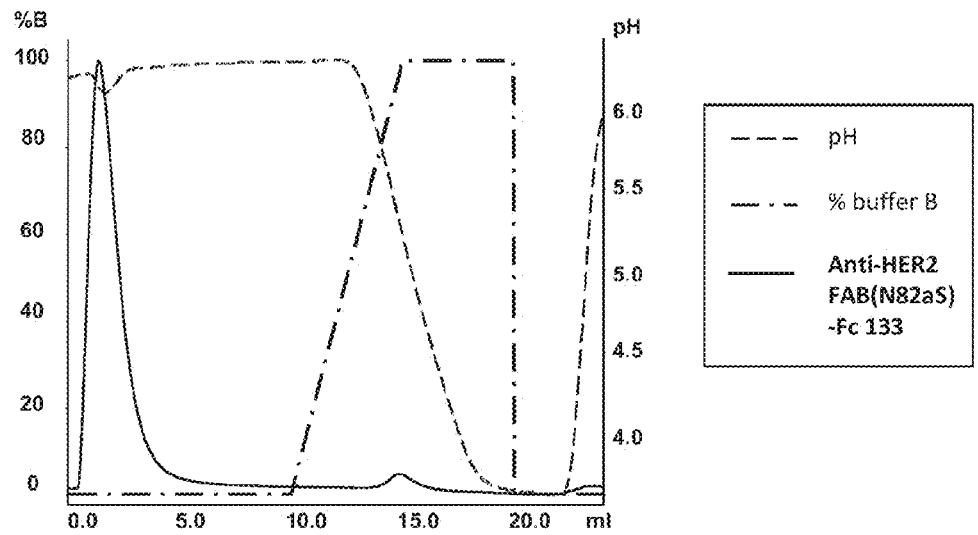

The use of the MabSelect™ resin was validated by preparing a recombinant anti-HER2 FAB fragment derived from the parent anti-HER2 homo-dimeric immunoglobulin described earlier that is known to be of the VH3-23 variable domain subclass (abbreviated herein as anti-HER2 FAB; heavy chain with SEQ ID NO: 5 and light chain with SEQ ID NO: 3), and assaying the fragment onto the MabSelect™ and MabSelect SuRe™ columns (having a light chain based on the VK subclass I, the FAB fragment was first purified in capture-elution mode using protein L chromatography before Protein A gradient chromatography was performed on MabSelect™ or MabSelect SuRe™ columns, protocol for both columns followed the protocol described the Materials and Methods section). As shown in FIG. 4C, the VH3 based anti-HER2 FAB only bound to the MabSelect™ column, confirming that the MabSelect SuRe™ resin lacks binding to the VH3 based FAB fragments; at least as far as monomeric VH3 based FAB fragments are concerned, and further contrasted with the results observed earlier for the VH3 based homo-dimeric immunoglobulins with engineered Fc regions having no binding to Protein A. Conversely, the anti-HER2 FAB showed strong binding to the MabSelect™ column which offered the possibility to assay for VH3 based FAB variants that would have no or reduced Protein A binding.

To abrogate Protein A binding in VH3 based FAB fragments, critical Protein A binding residues in VH3 domains were identified from the crystal structure of a human FAB fragment in complex with the D domain of Protein A (PDB code: 1DEE; Graille M et al., (2000) Proc Natl Acad Sci USA, 97(10): 5399-5404). This analysis was used as a starting point for rational design wherein the nature of the substitutions undertaken was based on sequence comparison between Protein A binding and non-Protein A binding VH subclasses from human origin. FIG. 5 shows an alignment of one representative framework for each human heavy chain variable domain subclass. Amino acid positions 15, 17, 19, 57, 59, 64, 65, 66, 68, 70, 81, 82a, and 82b (Kabat numbering) were identified as part of the protein-protein interaction interface between the D domain of Protein A and the VH3 based FAB fragment in the 1DEE structure. Amongst human VH subclasses, VH3 is the only subclass to bind Protein A, and residues at equivalent amino acid sequence positions in other subclasses were selected to be the source of the substitutions with the view to abrogate or reduce Protein A binding while having potentially reduce immuno-genicity—since these substitutions involved the replacement of one residue with another naturally occurring residue at the same equivalent amino acid position found in a non-Protein A binding human VH subclass.

Mutations were introduced in the sequence of the aforementioned anti-HER2 FAB fragment by standard PCR based mutagenesis techniques, the following substitutions were made: G65S (heavy chain with SEQ ID NO:6 and light chain with SEQ ID NO: 3), R66Q (heavy chain with SEQ ID NO: 7 and light chain with SEQ ID NO: 3), T68V (heavy chain with SEQ ID NO: 8 and light chain with SEQ ID NO: 3), Q81E (heavy chain with SEQ ID NO: 9 and light chain with SEQ ID NO: 3), N82aS (heavy chain with SEQ ID NO: 10 and light chain with SEQ ID NO: 3), and the combination R19G/T57A/Y59A (heavy chain with SEQ ID NO: 11 and light chain with SEQ ID NO: 3).

In addition, the T57A substitution (heavy chain with SEQ ID NO: 12 and light chain with SEQ ID NO: 3), and T57E substitution (heavy chain with SEQ ID NO: 13 and light chain with SEQ ID NO: 3) were made. T57A was previously shown to abrogate Protein A binding in WO2010075548, and T57E was designed to introduce a charged residue that may disrupt the VH3-Protein A interaction. Having a light chain based on the VK subfamily I, FAB mutants were first purified in capture-elution mode using Protein L chromatography, and further assayed for Protein A binding using the MabSelect™ column operated under gradient mode as described in the Materials and Methods section. FIG. 6 shows that only T57A, T57E, G65S, Q81E, N82aS and the combination R19G/T57A/Y59A abrogated or reduced anti-HER2 FAB binding to the MAbSelect™ resin. Substitutions G65S, Q81E and N82aS are preferred when abrogating Protein A binding in VH3 based FAB fragments since these mutations substitute for the sequence equivalent residue found in non-Protein A binding VH subclasses thereby potentially reducing immunogenicity.

Antibody affinity and specificity is essentially confined to the CDR regions, however, framework substitutions may impact on antibody properties as shown in the case of several humanized antibodies. To assess if the above substitutions may impact the specificity and/or the affinity of VH3 derived antibodies, two of the preferred FAB mutants were assayed for HER2 antigen binding by Surface Plasmon Resonance (SPR). SPR measurements with recombinant HER2 antigen were performed as described in the Materials and Methods section. Both preferred mutants showed identical binding to the HER2 antigen when compared to the original FAB molecule (FIG. 7) demonstrating that the substitutions had not impact in terms of specificity or affinity. It is therefore expected that these substitutions could be broadly used to engineer out Protein A binding in VH3 derived antibody molecules without significant loss of antigen binding.

Two of these preferred substitutions were introduced in the anti-HER2 homo-dimeric immunoglobulin and anti-HER2 scFv-Fc molecule described earlier, and variants were assayed for binding onto the MabSelect SuRe™ resin. The following variants were prepared: anti-HER2 scFv(G65S)-Fc 133 (heavy chain with SEQ ID NO: 14), anti-HER2 scFv(N82aS)-Fc 133 (heavy chain with SEQ ID NO: 15), anti-HER2 FAB(G65S)-Fc 133 (heavy chain with SEQ ID NO: 16 and light chain with SEQ ID NO: 3), and anti-HER2 FAB(N82aS)-Fc 133 (heavy chain with SEQ ID NO: 17 and light chain with SEQ ID NO: 3).

FIG. 8 shows the profiles from the MabSelect SuRe™ chromatography for all four mutants. All variants now displayed reduced to almost no binding to the MabSelect SuRe™ column indicating a successful removal of Protein A binding with the previously identified substitutions. More importantly, it was concluded that when combined with Protein A differential purification techniques, substitutions which abrogate or reduce VH3 based FAB affinity for Protein A will allow the preparation of hetero-dimeric immunoglobulins wherein at least one VH3 variable domain is present.

Example 2

Antigen Binding Sites that Target the Human CD3 Antigen, Tumour Associated Antigens and Inflammatory Cell Surface Antigens Antigen Binding Sites Against the Human CD3 Antigen The human CD3 epsilon subunit was selected to drive T cell redirect killing via bispecific engagement.

Humanized Variants of the Mouse OKT3 Antibody

The anti-human CD3 epsilon antigen binding site used herein was derived from the mouse OKT3 antibody (Muromonab-CD3, trade name Orthoclone OKT3, marketed by Janssen-Cilag and subsequently discontinued; murine variable heavy chain and light chain domains with SEQ ID NO: 18 and 19, respectively). OKT3 murine variable domains were humanized and formatted as scFv and FAB fragments.

Humanization followed the method described by Jung S & Plückthun A (1997, Protein Eng, 10(8): 959-66) to produce a highly stable humanized variant that would be suitable for both FAB and scFv formatting. The method makes use of the highly stable pair of VH/VL domains found in the Herceptin® antibody (rhuMAbHER2, huMAB4D5-8, trastuzumab or trade name Herceptin®; U.S. Pat. No. 5,821, 337; variable heavy chain and light chain domains with SEQ ID NO: 20 and 21, respectively) and follows the workflow of a humanization process onto fixed frameworks (Almagro J C & Fransson J (2008), Front Biosci, 13: 1619-33). Since the Herceptin® antibody is originally derived from the highly stable human families of germline framework VH3 and VK1, germline frameworks from these two families can be equally used as a source of fixed frameworks. Alternatively, the human VK3 germline light chain framework family can be used instead of VK1 as it also has good stability properties (Ewert S et al., (2003) J Mol Biol, 325: 531-553). In addition to mouse antibodies, human antibodies can be engineered using this fixed framework method to improve stability. Preferred is the use of the human germline framework IGHV3-23*04, IGKV1-39*01 and IGKV3-20*01 having SEQ ID NO: 22, 23 and 24, respectively (referenced according to IMGT® (the international ImMunoGeneTies information system (Lefranc M P et al. (1999) Nucleic Acids Res, 27(1): 209-12; Ruiz M et al. (2000) Nucleic Acids Res, 28(1): 219-21; Lefranc M P (2001) Nucleic Acids Res, 29(1): 207-9; Lefranc M P (2003) Nucleic Acids Res, 31(1): 307-10; Lefranc M P et al., (2005) Dev Comp Immunol, 29(3): 185-203; Kaas Q et al., (2007) Briefings in Functional Genomics & Proteomics, 6(4): 253-64).

To this aim a first humanized antibody was constructed wherein the CDRs in the variable domains of the Herceptin® antibody were respectively replaced with the CDRs from the mouse OKT3 antibody and benchmarked against a chimera of the mouse OKT3 antibody (variable heavy chain and light chain with SEQ ID NO: 25 and 26, and referred herein as the chimeric OKT3 antibody).

The prototype antibody (variable heavy chain and light chain with SEQ ID NO: 27 and 39, and abbreviated VH/VL) had increased production levels in transient expression tests and increased FAB stability as measured by differential scanning calorimetry but had no binding to HPB-ALL cells (assessed by median fluorescence intensity in FACS experiments, see Materials and Methods section), a human CD3 epsilon positive T cell tumour line (FIG. 9A).

Based on a 3D model of the first prototype pair of variable domains, a subset of back mutations (from CDR grafted Herceptin® prototype to mouse OKT3 sequence) were selected and tested: I34M, V48I, A49G, R58N, R58Y, I69L, A71T and T73K in the variable heavy chain domain and M4L, V33M, A34N, L46R, L47W, R66G, F71Y and P96F in the variable light chain (Kabat numbering). Note that the R58N substitution corresponds to a CDR grafted Herceptin® prototype-to-mouse OKT3 mutation while the R58Y substitution corresponds to a CDR grafted Herceptin® prototype-to-human IGHV3-23*04 germline substitution. The engineering strategy with regard to the combination of substitutions was based on the complementarity of the different substitutions in terms of their putative influence on CDR regions and/or variable domain packing and/or immunogenicity.

In a first approach, all candidates were formatted as human IgG1 antibodies. Best variants were selected according to expression levels, FAB fragment thermo-stability and ability to bind HPB-ALL cells by FACS. Best humanized variants had the Protein A binding site present within their VH domain abrogated using the G65S or N82aS substitution. This engineering step was needed to further produce safe T cell retargeting BEAT antibodies free of anti-CD3 homo-dimers.

Figure 9D:
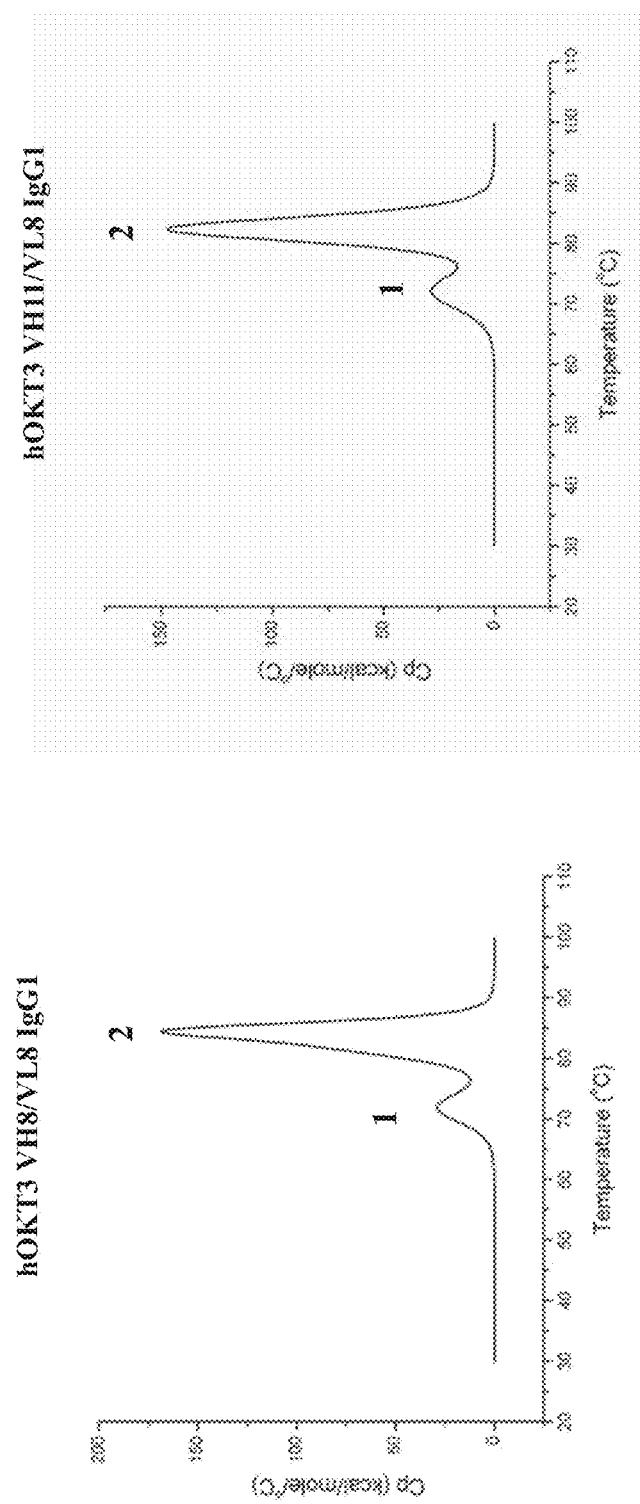

Back mutations in the VH of: I34M, A49G and A71T along with back mutations in the VL of: M4L. L46R, L47W and F71Y restored affinity. Best combinations of variable domains were VH8/VL4, VH8/VL8, VH11/VL4 and VH11/L8 as these retained most of parental cell binding (FIG. 9A-C). In addition, combinations VH8/VL8 (variable domains with SEQ ID NO: 48 and 51, respectively) and VH1/VL8 (variable domains with SEQ ID NO: 49 and 51, respectively) had enhanced FAB stability and (+2.8° C. and +1.6° C., respectively, FIG. 9D).

Figure 9F:
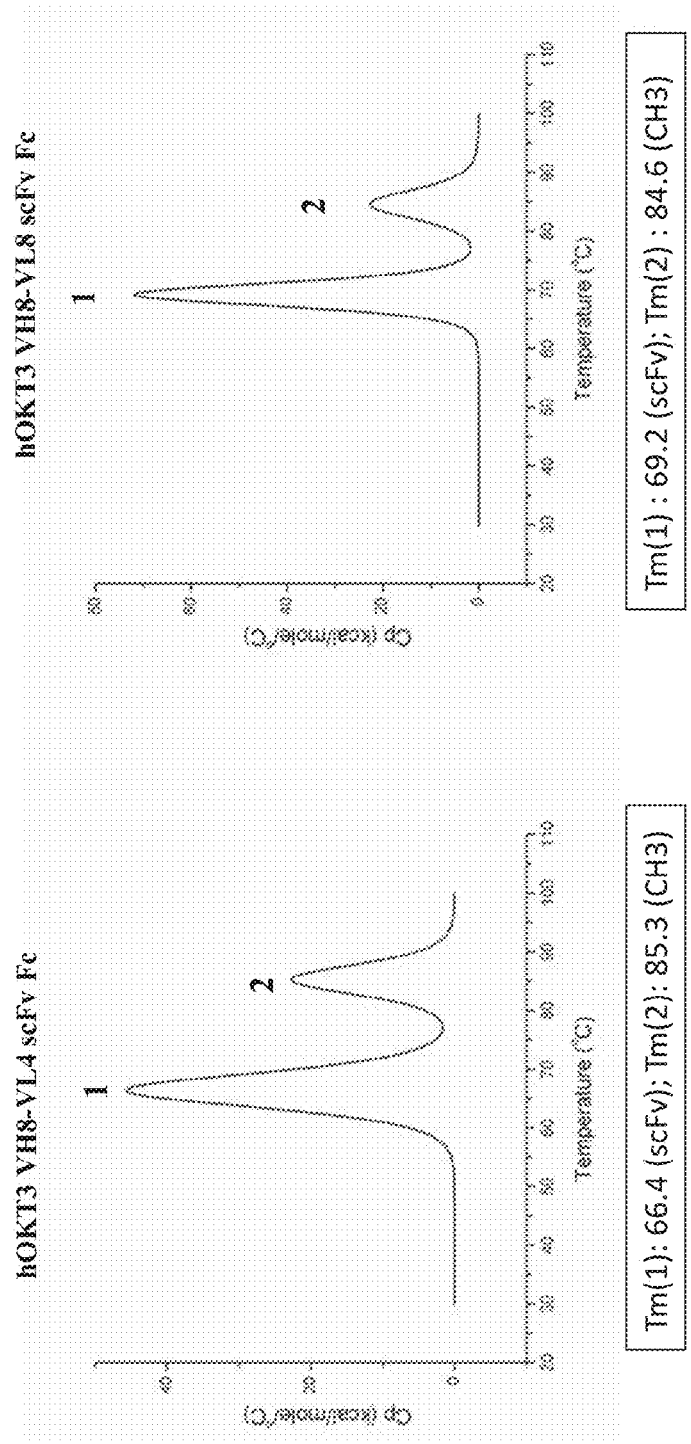

Finally, best humanized variants were also reformatted as scFv-Fc fusions and transiently expressed. Variants were ranked in terms of their relative affinity, stability, expression levels in transient transfection in this format (FIG. 9E). Best combinations of variable domains in a scFv-Fc fusion format were similar to the combinations identified in an antibody format: VH8-VL4 (scFv fragment with SEQ ID NO: 58) and VH8-VL8 (scFv fragment with SEQ ID NO: 59). Both scFv fragments had good thermal stability with the scFv-Fc fusion format (FIG. 9F).

Humanized Variants of the Mouse SP34 Antibody

The mouse antibody SP34 was first described in 1985 (Pessano S et al., (1985) EMBO J, 4(2):337-44). It was produced by a hybridoma obtained from mice immunised with denatured protein extracts from HPB-ALL cells, the antibody has human specificity and cross-reactivity to cynomolgus monkey. SP34 epitopes on human and cynomolgus monkey CD3 epsilon subunit are known.

Following the methods and work flow described in this example supra, humanized VH and VL domains for the murine SP34 antibody having a VH domain with SEQ ID NO: 60 and a VL domain with SEQ ID NO: 61 were engineered via CDR grafting onto the VH3-23 and VK3 germline frameworks, respectively. The resulting VH3 based variable domains can be further abrogated for Protein A binding using the G65S or N82aS substitutions (Kabat numbering) depending on their usage in a BEAT antibody format.

To this aim a first humanized antibody was constructed wherein the CDRs in the variable domains of a human antibody having a germline VH3 heavy chain domain and a germline VK3 light chain domain were respectively replaced with the CDRs from the mouse SP34 antibody. The resulting humanized antibody was used a starting point for further affinity improvement and benchmarked against a chimera of the SP34 antibody (heavy chain and light chain with SEQ ID NO: 62 and 63, respectively, and referred herein as the chimeric SP34 antibody).

The prototype antibody (variable heavy chain and light chain with SEQ ID NO: 64 and 69, and abbreviated VH1/VL1) had a low binding to human CD3 epsilon 1-26_Fc fusion protein (assessed by SPR, see Materials and Methods section and FIG. 10A).

Based on a 3D model of the first prototype pair of variable domains, a subset of substitutions that corresponded to either back mutations between the CDR grafted human germline VH3/VK3 prototype and mouse SP34 sequence (human-to-mouse or mouse-to-human substitutions) or rationally designed amino acid changes was selected. The following changes were made and tested in various combinations: W100eF, and W100eY in the variable heavy chain domain and A2I, S25A, T27A, G27aA, V27cA, T28A, T29A, S30A, N31A, Y32A, E38Q, F44P, G46L, T51A, N52A, K53A, R54A, P56A, L66G, D69T, F87Y, Q89A, W91F, Y92A, S93A, N94A, and Q100G in the variable light chain (Kabat numbering; see FIG. 10A). The engineering strategy with regard to the combination of substitutions was based on the complementarity of the different substitutions in terms of their putative influence on CDR regions and/or variable domain packing and/or immunogenicity and/or impact on transient expression in mammalian cells.

In a first approach, all candidates were formatted as human IgG1 antibodies and later further tested in a scFv-Fc fusion protein format (FIG. 10B) with some variants having the Protein A binding site present within their VH domain abrogated using the G65S. Best humanized candidates were selected according to expression levels and ability to bind the human and cynomolgus monkey CD3 epsilon 1-26_Fc fusion proteins by SPR.

Preferred combinations of heavy chain and light chain variable domains with regard to antigen binding and recombinant expression were as follows: VH1 (SEQ ID NO: 101) or VH2 (SEQ ID NO: 102) or VH3 (SEQ ID NO: 103) or VH5 (SEQ ID NO: 104) paired with light chains domains VL21 (SEQ ID NO: 105) and VL32 (SEQ ID NO: 106).

HER2

Bispecific antibodies that would redirect T cells to kill HER2 positive cancer cells are useful to treat different forms of human breast cancer. Anti-HER2 antibodies have been described (Blumenthal G M et al., (2013) Clin Cancer Res, 19(18): 4911-6) with some being currently used in the clinic or currently under clinical investigations in humans (Tsang R Y & Finn R S (2012) Br J Cancer, 106(1): 6-13).

The anti-HER2 antigen binding site as used herein was derived from the recombinant humanized anti-HER2 antibody Herceptin® (see section 1.1) formatted as a FAB fragment (FAB heavy chain fragment with SEQ ID NO: 5 and light chain SEQ ID NO: 3) or a scFv fragment (SEQ ID NO: 107). In some formats, the Protein A binding present in the VH domain of the humanized anti-HER2 antibody 4D5 (VH3 domain subclass) was abrogated using the G65S substitution (FAB fragment with heavy chain having SEQ ID NO: 108 and light chain SEQ ID NO: 3 or scFv fragment with SEQ ID NO: 109) or the N82aS substitution (FAB fragment with heavy chain having SEQ ID NO: 110 and light chain SEQ ID NO: 3 or scFv fragment with SEQ ID NO: 111).

CD38

CD38 is a type II transmembrane glycoprotein which is normally found on hemopoietic cells and in solid tissues. CD38 is also expressed in a variety of malignant hematological diseases. Bispecific antibodies that would redirect T cells to kill CD38 positive cancer cells will be useful to treat a variety of malignant hematological diseases, including multiple myeloma, B-cell chronic lymphocytic leukaemia, B-cell acute lymphocytic leukaemia, Waldenström's macroglobulinemia, primary systemic amyloidosis, mantle-cell lymphoma, pro-lymphocyticimyelocytic leukaemia, acute myeloid leukaemia, chronic myeloid leukaemia, follicular lymphoma, NK-cell leukaemia and plasma-cell leukaemia. Several anti-CD38 antibodies have been described as research reagents or therapeutic candidates (PCT Publication No: WO2006099875). Amongst the best characterized anti-human CD38 antibodies are OKT-10 and HB-7 mouse hybridomas (Hoshino S et al., (1997) J Immunol, 158(2): 741-7).

In a first approach, anti-human CD38 antigen binding sites can be derived from mouse hybridomas OKT10 (variable heavy chain and light chain with SEQ ID NO: 112 and 113, respectively) or HB-7 (variable heavy chain and light chain with SEQ ID NO: 114 and 115, respectively) and humanized versions thereof which can be further formatted as a FAB or scFv fragments. Following the methods and work flow described in Example 2.1, humanized VH and VL domains for the HB-7 hybridoma are can engineered via CDR grafting onto the VH3-23 and VK1 germline frameworks, respectively.

Figure 11A:
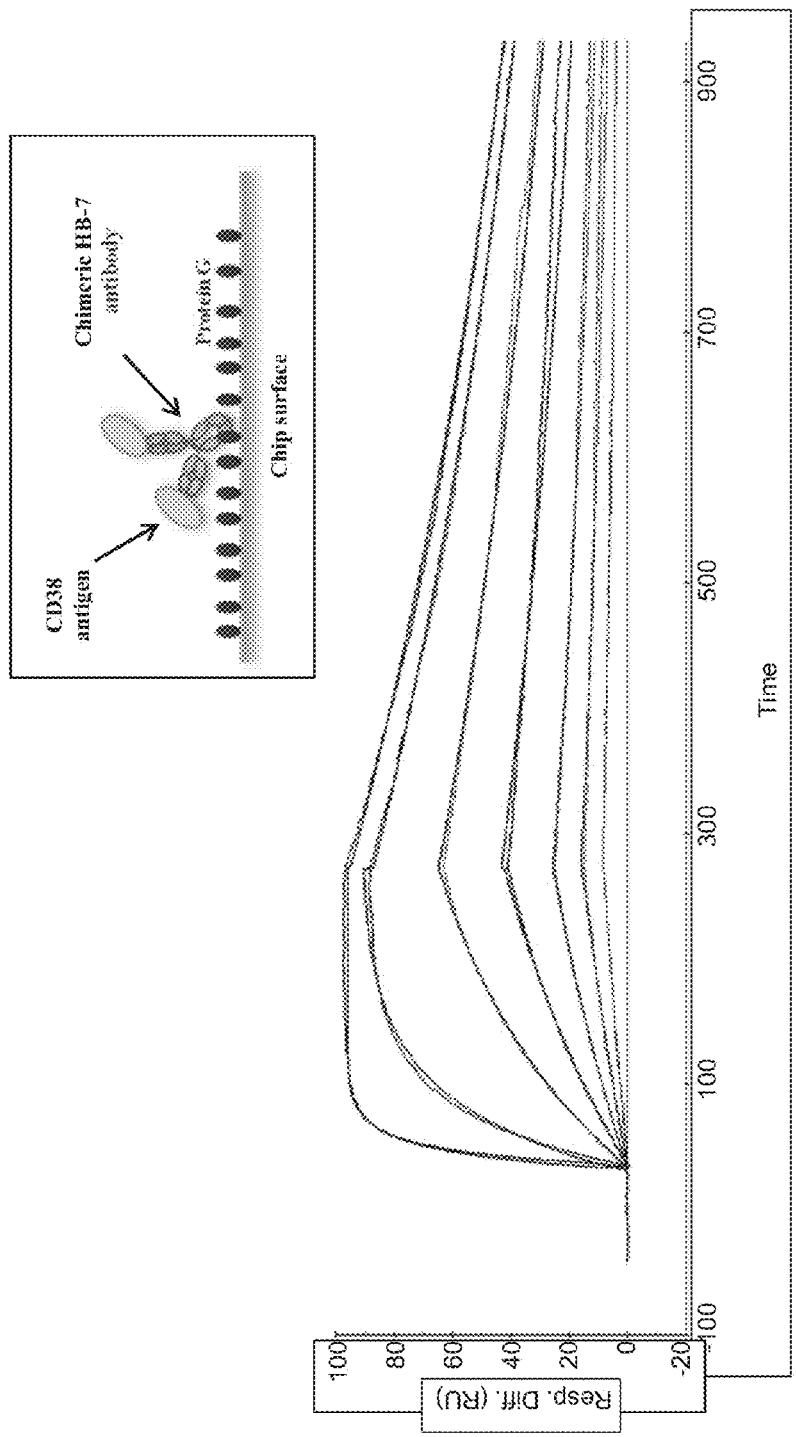
Figure 11B:
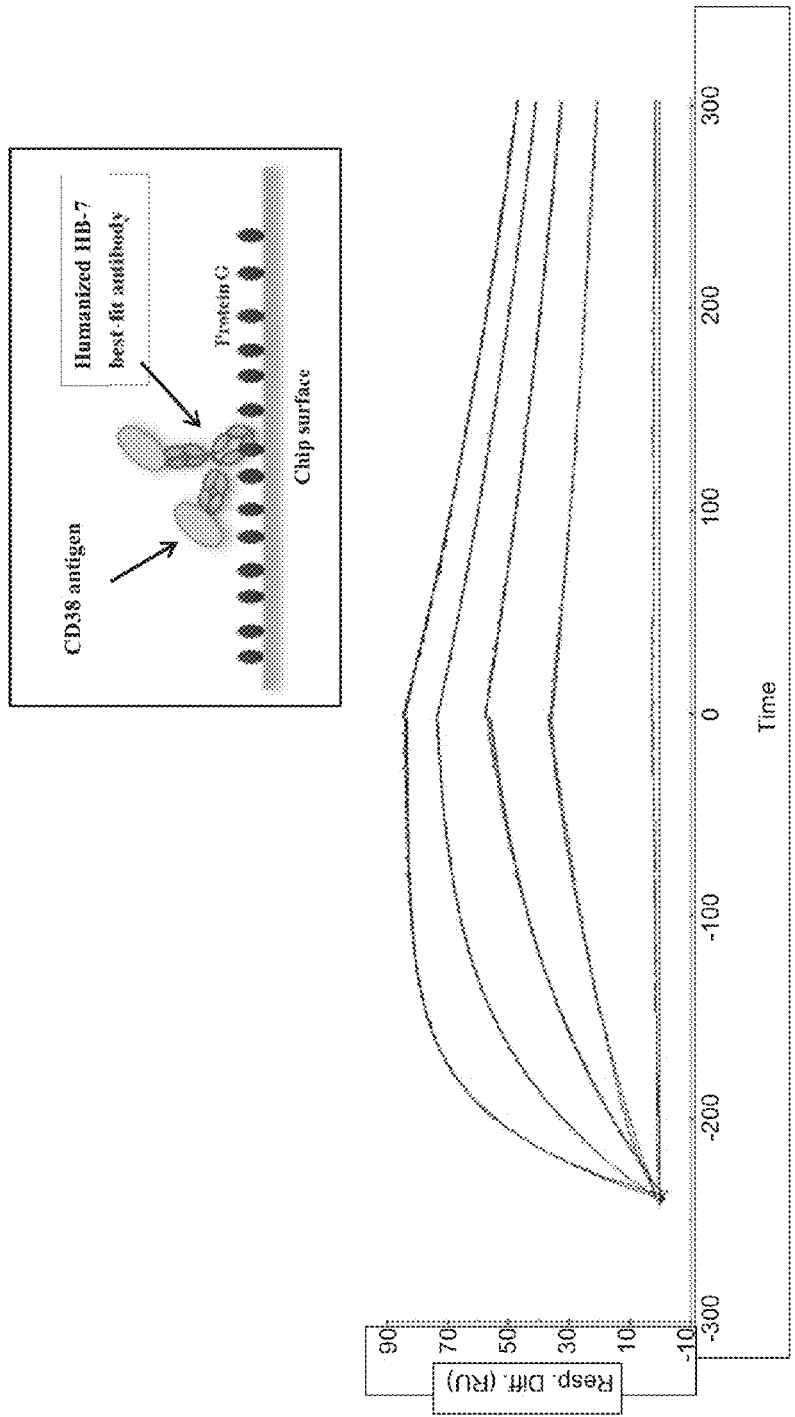

In a second approach, following the so-called best-fit humanization method described by Almagro J C & Fransson J (Front Biosci, (2008) 13: 1619-33), best-fit humanized VH and VL domains for the HB-7 hybridoma were engineered via CDR grafting onto the human IGHV4-59*03 and IGKV1-NL1*01 germline frameworks, respectively (referenced according to IMGT® supra). Humanized VH and VL variants with different degree of back mutations were investigated in silico and one preferred selection of humanized VH and VL was transiently expressed as a human IgG1 format and referred herein as humanized HB-7 best-fit VH (SEQ ID NO: 116) and VL (SEQ ID NO: 117) domains. The following mouse back mutations were introduced: (VH) S35H, I37V, I48L, V67L, V71K, T73N, F78V, Y91F and (VL): M4L, L48I, Y49S, T69K (Kabat numbering). The humanized HB-7 best-fit antibody (heavy chain with SEQ ID NO: 118 and light chain with SEQ ID NO: 119) stained CHO[CD38] recombinant cells by FACS (data not shown). The humanized HB-7 best-fit antibody had a binding affinity for the CD38 extracellular region similar to that of the chimeric HB-7 antibody (heavy chain with SEQ ID NO: 120 and light chain with SEQ ID NO: 121) when assayed by SPR (KDs of 3.6 and 2.5 nM, respectively; FIG. 11A (chimeric) and FIG. 11B (humanized)). Surprisingly, the humanized HB-7 best-fit antibody displayed a significant enhancement (+14.6° C.) in FAB fragment stability compared to the chimeric HB-7 antibody as judged from calorimetry profiles (76.4° C. (chimeric) vs 91.0° C. (humanized), FIG. 11F).

Figure 11C:
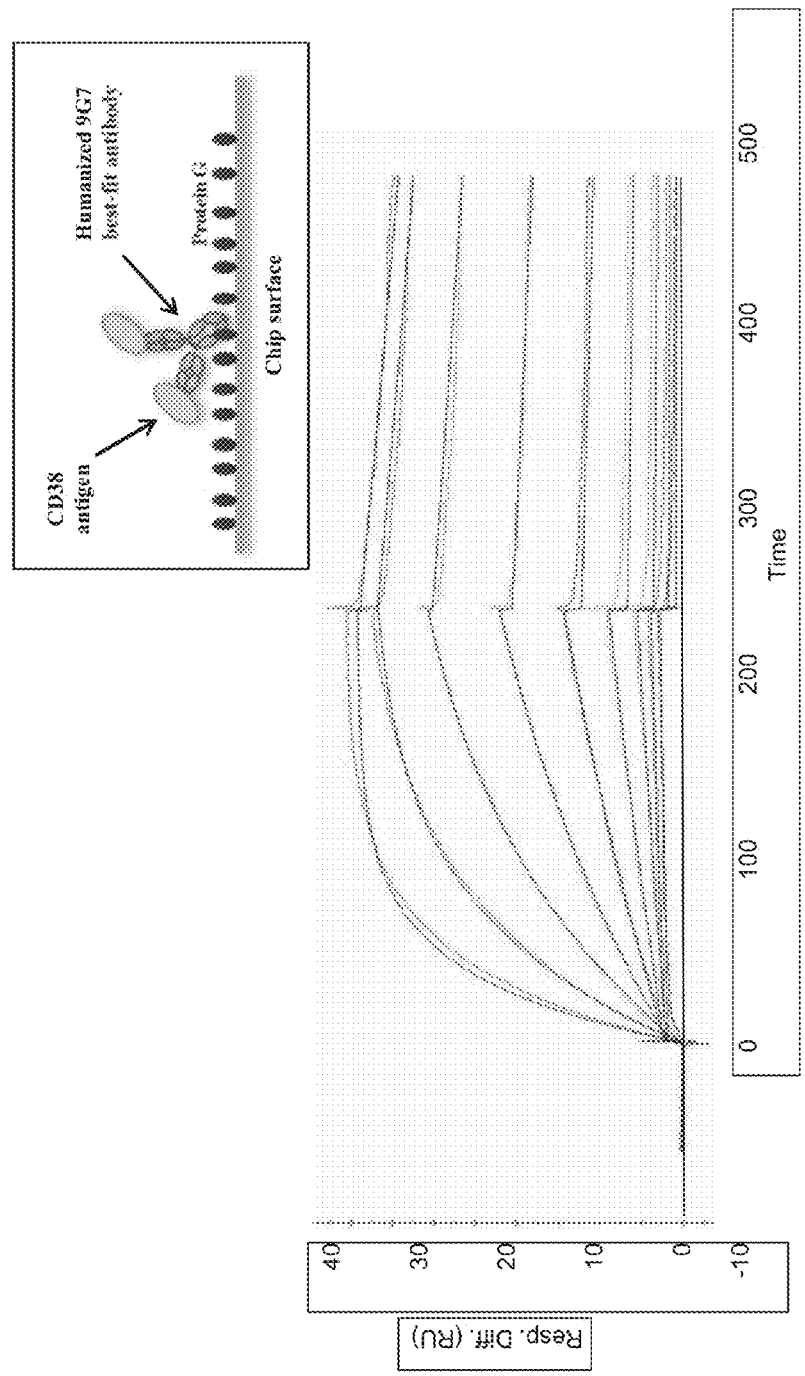

In a third approach, mice immunized with the human CD38 extracellular domain and human CD38+ cells were used to generate novel hybridoma candidates against human CD38. Methods to generate hybridomas are known and the methods used herein were similar to methods disclosed in PCT Publication No: WO2013008171. The 9G7 mouse antibody candidate had a high affinity for both human and cynomolgus monkey CD38 (variable heavy chain and light chain with SEQ ID NO: 122 and 123, respectively). This mouse antibody was first humanized according to the methods described in this example supra. Using the best-fit approach, the germline VH framework IGHV2-5*09 and VK framework IGKV1-33*01 (referenced according to IMGT® supra) were selected as a starting point for the humanization process. Post CDR grafting, the first antibody prototype (formatted as a human IgG1 isoptype, heavy chain SEQ ID NO: 124 and light chain with SEQ ID NO: 125) exhibited a strong binding to human CD38 only three fold lower than the mouse parental antibody as judged by SPR (chimeric 9G7 antibody with heavy chain SEQ ID NO: 126 and light chain with SEQ ID NO: 127; KD of 0.3 nM and 1 nM for the chimeric 9G7 antibody (data not shown) and first humanized prototype (data not shown), respectively). Affinity improved by two fold upon introduction of the F36Y back mutation in the variable light chain of the antibody (Kabat numbering) (the resulting antibody is referred herein as the humanized 9G7 best-fit antibody with heavy chain SEQ ID NO: 124 and light chain with SEQ ID NO: 128; KD of 0.5 nM for human CD38, FIG. 11C). The humanized 9G7 best-fit antibody also exhibited a high affinity for the cynomolgus monkey CD38 antigen (KD of 3.2 nM, data not shown), and an enhanced FAB thermo-stability (FAB Tm from DSC scans) over the chimeric 9G7 antibody (94° C. vs. 82.2° C. for the humanized 9G7 best-fit antibody and the chimeric 9G7 antibody, respectively; see FIG. 11G). The humanized 9G7 best-fit antibody has heavy chain variable domain with SEQ ID NO: 129 and light chain variable domain with SEQ ID NO: 130.

Figure 11D:
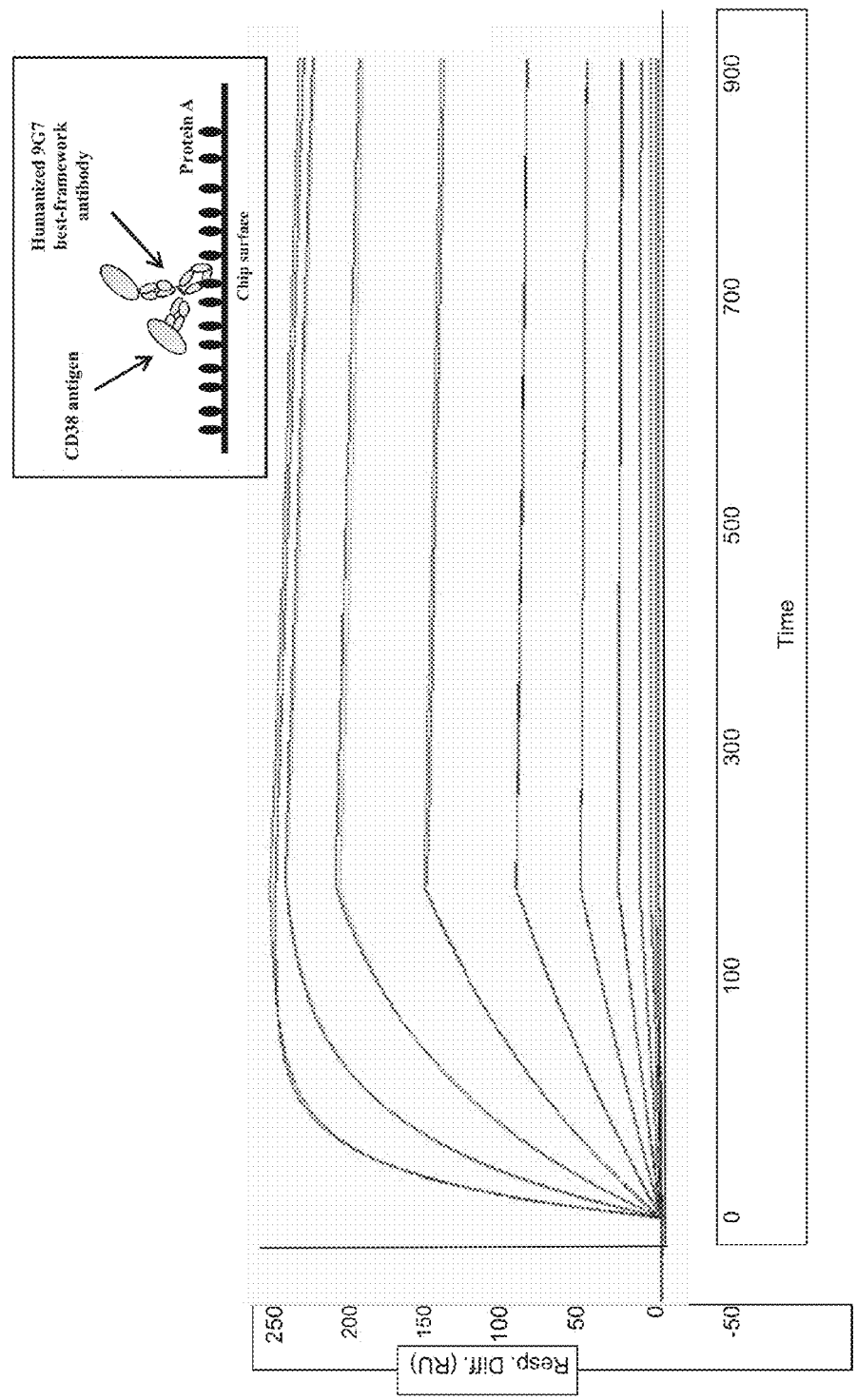

In addition, the 9G7 mouse antibody was humanized following the best-framework approach via CDR grafting onto the VH3-23 and VK1 germline frameworks. Humanized V H and VL variants with different degree of back mutations were investigated in silico and one preferred selection of humanized VH and VL combination was transiently expressed as a human IgG1 antibody (the resulting antibody is referred herein as the humanized 9G7 best-framework antibody with heavy chain SEQ ID NO: 131 and light chain with SEQ ID NO: 132). The following mouse back mutations were introduced: (VH) A24F, V37I, V48L, S49A, F67L, R71K, N73T, L78V, and K94R, and (VL) F36Y (Kabat numbering). This antibody exhibited a strong binding to human CD38 and cynomolgus monkey CD38 with affinity constants similar to that of the humanized 9G7 best-fit antibody (KD of 0.4 and 1 nM for human and cynomolgus monkey CD38, respectively; FIG. 11D). FAB thermo-stability (FAB Tm from DSC scans) was also very similar to that of the 9G7 best-fit F36Y humanized variant (89.2° C., see FIG. 11H). FIG. 11J summarizes the different humanized 9G7 antibodies described above. The humanized 9G7 best-framework antibody has heavy chain variable domain with SEQ ID NO: 133 and light chain variable domain with SEQ ID NO: 134.

Figure 11I:
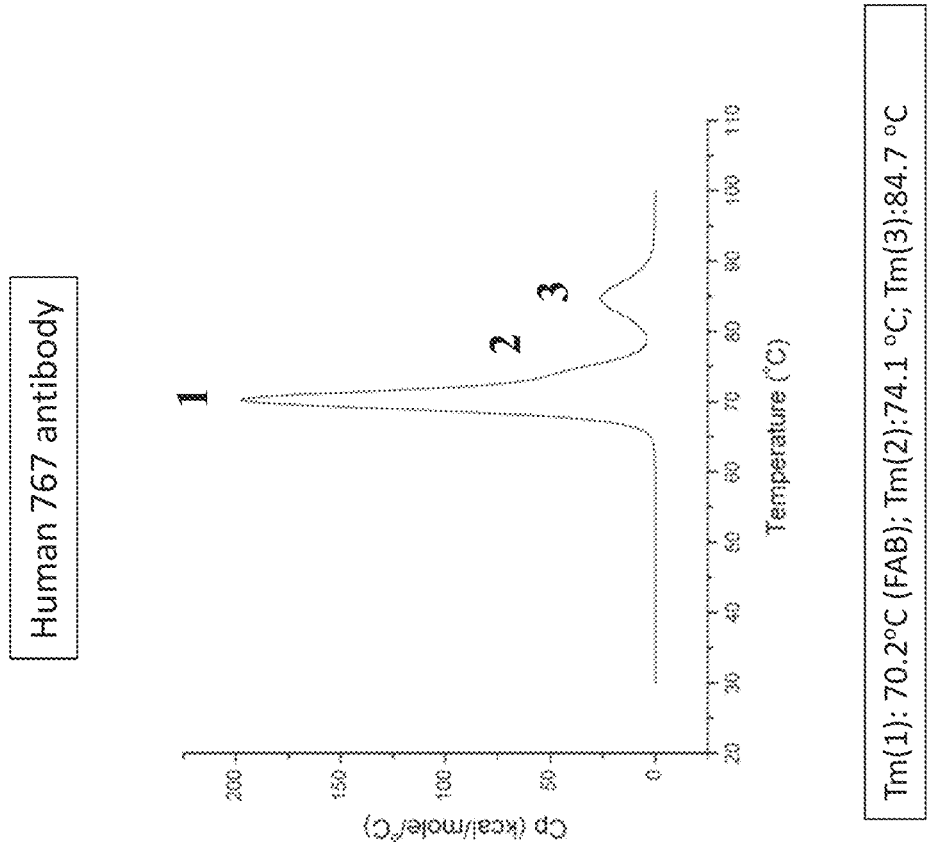

In a fourth approach, an antibody phage library was screened to generate additional scFv fragments against human CD38. The library had a diversity based on the naturally occurring human V genes. This donor derived antibody phage display library used cDNAs amplified from blood lymphocytes originating from 48 human donors of which 70% had an autoimmune disease (vasculitis, systemic lupus erythematosus, spondiloarthropathy, rheumatoid arthritis and scleroderma). Library construction followed the protocol described by Schofield et al. (2007, Genome Biol., 8(11): R254) with a total diversity of 2.53×10e10 clones. ScFv fragments recognizing human and/or cynomolgus monkey CD38 were isolated from this donor derived phage display library as follows. ScFv fragments were isolated in a series of repeated selection cycles on recombinantly derived human and/or cynomolgus monkey CD38 antigens (see Materials and Methods section). Methods to screen antibody phage display libraries are known (Viti F et al., (2000) Methods Enzymol, 326: 480-505). Briefly, following incubation with the library, the immobilised antigen which had been previously coated on a plastic immunotube (overnight in PBS at a concentration of 20 µg/ml) or captured on streptavidin beads (when using a biotin labelled form of the antigen, antigen captured at a concentration of 50 nM throughout the selection process), bound phages were recovered whist unbound phages were washed away. Bound phages were rescued as described by Marks et al (Marks J D et al., (1991) J Mol Biol, 222(3): 581-97) and the selection process repeated three times. Over one thousand clones from the second and third round of panning were expressed and analysed by ELISA against the human and cynomolgus monkey CD38 antigens. Positive clones were subjected to DNA sequencing and some of the unique clones were further analysed for their ability to bind cell lines expressing human CD38. Following a first round of panning on a biotin labelled version of the human CD38 antigen immobilized on streptavidin beads and a second round of panning on a biotin labelled version of the cynomolgus monkey CD38 antigen immobilized on streptavidin beads, one preferred scFv fragment (clone No 767) having a variable heavy chain sequence with SEQ ID NO: 135 and a variable light chain with SEQ ID NO: 136 was selected for its ability to bind both human and cynomolgus monkey CD38. When formatted as a human IgG1 antibody, clone 767 had a KD of about 300 nM for human CD38 (FIG. 11E) and about 1.2 µM for cynomolgus monkey CD38 (data not shown) (clone 767 IgG1 antibody is referred herein as human 767 antibody with heavy chain SEQ ID NO: 137 and light chain with SEQ ID NO: 138). FAB thermo-stability (FAB Tm from DSC scans) was 70.2° C. (FIG. 11I). Clone 767 VH domain belongs to the VH3 domain subclass.

OX40

A bispecific antibody targeting CD3 and OX40 will allow targeting and depletion of activated T lymphocytes. In this combination, the activated T lymphocytes, which express both CD3 and OX40 molecules, will engage into a mutual killing process resulting in rapid cell disappearance. Co-engagement of human CD3 and OX40 by a bispecific antibody may achieve an effective elimination of pathogenic T cells in a short time frame. OX40 is a member of the TNFR-superfamily of receptors and was first identified in 1987 as a 50 kDa glycoprotein expressed on activated CD4+ T cells from the rat (Paterson D J et al., (1987) Mol. Immunol. 24: 1281-90). Unlike CD28, OX40 is not constitutively expressed on naïve T cells but is induced after engagement of the T-Cell Receptor (TCR). OX40 is a secondary costimulatory molecule, expressed after 24 to 72 hours following activation; its ligand, OX40L, is also not expressed on resting antigen presenting cells, but is expressed following their activation.

The mouse anti-human OX40 antibody disclosed in PCT Publication No: WO2013008171 (heavy chain and light chain domains with SEQ ID NO: 139 and 140, respectively) can be used as a source of anti-human OX40 antigen binding site. A humanized version of this antibody based on the best-fit humanization method is also disclosed in PCT Publication No: WO2013008171 (heavy chain and light chain domains with SEQ ID NO: 141 and 142, respectively and with both antibodies being amendable for reformatting into a BEAT format.

Following the methods and work flow described in Example 2.1, humanized VH and VL domains for the anti-human OX40 hybridoma are engineered via CDR grafting onto the VH3-23 and VK1 germline frameworks, respectively. The resulting VH3 based variable domains are further abrogated for Protein A binding using the G65S or N82aS substitutions (Kabat numbering) depending on their usage in a BEAT antibody format. Only two humanized VH and VL domains were investigated differing by their different degree of back mutations. Back mutations were identified from sequence alignments between the parent antibody variable domains and a CDR grafted VH3 and VK1 similar to the first prototype antibody and the approach described in Example 2.1. These CDR grafted variable domains have no back mutations and are referred to herein as mingrafts. These sequences were then further modified to include all the back mutations identified from the previous alignment and resulted in modified variable domain sequences referred to herein as maxgrafts. The resulting sequences are summarized below:

Humanized and stabilized anti-OX40 VH having no back mutations; abbreviated humanized anti-OX40/mingraft VH (SEQ ID NO: 278).

Humanized and stabilized anti-OX40 VH having all possible back mutations; abbreviated humanized anti-OX40/maxgraft VH (SEQ ID NO: 279).

Humanized and stabilized anti-OX40 VL having no back mutations; abbreviated humanized anti-OX40/mingraft VL (SEQ ID NO: 280).

Humanized and stabilized anti-OX40 VL having all possible back mutations; abbreviated humanized anti-OX40/maxgraft VL (SEQ ID NO: 281).

CD20

Bispecific antibodies that would redirect T cells to kill CD20 expressing B cells can be useful to treat different forms of human lymphomas cancers. Several anti-human CD20 antibodies have been described as research reagents or therapeutic candidates. Amongst the best characterized anti-human CD20 antibodies are the chimeric rituximab antibody and humanized variants thereof (chimeric rituximab antibody, trade name Rituxan®, PCT Publication No: WO1994011026; mouse VH domain of SEQ ID NO: 143 and VL domain of SEQ ID NO: 144).

Following the methods and work flow described in Example 2.1, humanized VH and VL domains for the rituximab chimeric antibody are engineered via CDR grafting onto the VH3-23 and VK1 germline frameworks, respectively. The resulting VH3 based variable domains are further abrogated for Protein A binding using the G65S or N82aS substitutions (Kabat numbering) depending on their usage in a BEAT antibody format. Two humanized VH and VL domains are investigated differing by their different degree of back mutations. Back mutations were identified from sequence alignments between the parent antibody variable domains and a CDR grafted VH3 and VK1 similar to the first prototype antibody and the approach described in Example 2.1. These CDR grafted variable domains have no back mutations and are referred to herein as mingrafts. These sequences were then further modified to include all the back mutations identified from the previous alignment and resulted in modified variable domain sequences referred to herein as maxgrafts. The resulting sequences are summarized below:

Humanized and stabilized Rituximab VH having no back mutations; abbreviated humanized Rituximab/mingraft VH (SEQ ID NO: 282).

Humanized and stabilized Rituximab VH having all possible back mutations; abbreviated humanized Rituximab/maxgraft VH (SEQ ID NO: 283).

Humanized and stabilized Rituximab VL having no back mutations; abbreviated humanized Rituximab/mingraft VL (SEQ ID NO:284).

Humanized and stabilized Rituximab VL having all possible back mutations; abbreviated humanized Rituximab/maxgraft VL (SEQ ID NO: 285).

EGFR

Bispecific antibodies that would redirect T cells to kill EGFR positive cancer cells can be useful to treat different forms of human cancers, preferably human pancreatic cancers and human colon cancers. Several anti-human EGFR antibodies have been described as research reagents or therapeutic candidates. Amongst the best characterized anti-human EGFR antibodies are the chimeric cetuximab antibody and humanized variants thereof. (chimeric cetuximab antibody, trade name Erbitux®, C225, IMC-C225; PCT Publication No: WO199640210; mouse VH domain with SEQ ID NO: 145 and mouse VL domain with SEQ ID NO: 146).

Following the methods and work flow described in Example 2.1, humanized VH and VL domains for the Erbitux® chimeric antibody are engineered via CDR grafting onto the VH3-23 and VK1 germline frameworks, respectively. The resulting VH3 based variable domains are further abrogated for Protein A binding using the G65S or N82aS substitutions (Kabat numbering) depending on their usage in a BEAT antibody format. Two humanized VH and VL domains are investigated differing by their different degree of back mutations. Back mutations were identified from sequence alignments between the parent antibody variable domains and a CDR grafted VH3 and VK1 similar to the first prototype antibody and the approach described in Example 2.1. These CDR grafted variable domains have no back mutations and are referred to herein as mingrafts. These sequences were then further modified to include all the back mutations identified from the previous alignment and resulted in modified variable domain sequences referred to herein as maxgrafts. The resulting sequences are summarized below:

Humanized and stabilized Erbitux VH having no back mutations; abbreviated humanized Erbitux/mingraft VH (SEQ ID NO: 286).

Humanized and stabilized Erbitux VH having all possible back mutations; abbreviated humanized Erbitux/maxgraft VH (SEQ ID NO: 287).

Humanized and stabilized Erbitux VL having no back mutations; abbreviated humanized Erbitux/mingraft VL (SEQ ID NO: 288).

Humanized and stabilized Erbitux VL having all possible back mutations; abbreviated humanized Erbitux/maxgraft VL (SEQ ID NO: 289).

Another well characterized anti-human EGFR antibody is the human panitumumab antibody and humanized variants thereof (human panitumumab antibody, trade name Vectibix®, PCT Publication No: WO2012138997; mouse VH domain with SEQ ID NO: 290 and mouse VL domain with SEQ ID NO: 291).

Following the methods and work flow described in Example 2.1, humanized VH and VL domains for the Vectibix® chimeric antibody are engineered via CDR grafting onto the VH3-23 and VK1 germline frameworks, respectively. The resulting VH3 based variable domains are further abrogated for Protein A binding using the G65S or N82aS substitutions (Kabat numbering) depending on their usage in a BEAT antibody format. Two humanized VH and VL domains are investigated differing by their different degree of back mutations. Back mutations were identified from sequence alignments between the parent antibody variable domains and a CDR grafted VH3 and VK1 similar to the first prototype antibody and the approach described in Example 2.1. These CDR grafted variable domains have no back mutations and are referred to herein as mingrafts. These sequences were then further modified to include all the back mutations identified from the previous alignment and resulted in modified variable domain sequences referred to herein as maxgrafts. The resulting sequences are summarized below:

Humanized and stabilized Vectibix VH having no back mutations; abbreviated humanized Vectibix/mingraft VH (SEQ ID NO: 292).

Humanized and stabilized Vectibix VH having all possible back mutations; abbreviated humanized Vectibix/maxgraft VH (SEQ ID NO: 293).

Humanized and stabilized Vectibix VL having no back mutations; abbreviated humanized Vectibix/mingraft VL (SEQ ID NO: 294).

Humanized and stabilized Vectibix VL having all possible back mutations; abbreviated humanized Vectibix/maxgraft VL (SEQ ID NO: 295).

CD19

Bispecific antibodies that would redirect T cells to kill CD19 expressing B cells will be useful to treat different forms of human blood and myeloid cancers. The human CD19 molecule is a structurally distinct cell surface receptor expressed on the surface of human B cells, including, but not limited to, pre-B cells, B cells in early development (i.e., immature B cells), mature B cells through terminal differentiation into plasma cells and malignant B cells. CD19 is expressed by most pre-B acute lymphoblastic leukemias (ALL), non-Hodgkin's lymphomas, B cell chronic lymphocytic leukemias (CLL), pro-lymphocytic leukemias, hairy cell leukemias, common acute lymphocytic leukemias and some Null-acute lymphoblastic leukemias (Nadler L M et al. (1983) J Immunol, 131: 244-250; Anderson K C et al., (1984) Blood, 63: 1424-1433; Loken M R et al. (1987) Blood, 70: 1316-1324; Uckun F M et al. (1988) Blood, 71: 13-29; Scheuermann R H & Racila E (1995) Leuk Lymphoma, 18: 385-397). The expression of CD19 on plasma cells further suggests it may be expressed on differentiated B cell tumors such as multiple myeloma, plasmacytomas, Waldenstrom's tumors (Grossbard M L et al. (1998) Br J Haematol, 102: 509-15; Treon S P et al. (2003) Semin Oncol, 30: 248-52).

Humanized anti-human CD19 antibodies described in PCT Publication No: WO2010/095031 utilise the VH3-23 and VK1 variable domain frameworks and can be used to produce bispecific antibodies as described in Example 2.1. The humanized anti-human CD19 antibody having a VH domain with SEQ ID NO: 296 and a VL domain with SEQ ID NO: 297 is used and further abrogated for Protein A binding using the G65S or N82aS substitutions (Kabat numbering) depending on its use in a BEAT antibody format.

IgE

Bispecific antibodies that would redirect T cells to kill membrane bound IgE positive B cells can be useful to treat different inflammatory disease such as asthma or fibrosis. Several anti-human IgE antibodies have been described as research reagents or therapeutic candidates. Amongst the best characterized anti-human IgE antibodies are the Omalizumab antibody (trade name Xolair®, USPTO publication No: U.S. Pat. No. 6,761,889, U.S. Pat. No. 6,329,509 and US20080003218A1; Presta L G et al., (1993) J Immunol, 151: 2623-2632; humanized VH domain with SEQ ID NO: 298 and VL domain with SEQ ID NO: 299) and variants thereof.

Following the methods and work flow described in Example 2.1, humanized VH and VL domains for the Omalizumab antibody are engineered via CDR grafting onto the VH3-23 and VK1 germline frameworks, respectively. The resulting VH3 based variable domains are further abrogated for Protein A binding using the G65S or N82aS substitutions (Kabat numbering) depending on their usage in a BEAT antibody format. Two stabilized VH and VL domains are investigated differing by their different degree of back mutations. Back mutations were identified from sequence alignments between the parent antibody variable domains and a CDR grafted VH3 and VK1 similar to the first prototype antibody and the approach described in Example 2.1. These CDR grafted variable domains have no back mutations and are referred to herein as mingrafts. These sequences were then further modified to include all the back mutations identified from the previous alignment and resulted in modified variable domain sequences referred to herein as maxgrafts. The resulting sequences are summarized below:

Stabilized Omalizumab VH having no back mutations; abbreviated stabilized Omalizumab/mingraft VH (SEQ ID NO: 300).

Stabilized Omalizumab VH having all possible back mutations; abbreviated stabilized Omalizumab/maxgraft VH (SEQ ID NO: 301).

Stabilized Omalizumab VL having no back mutations; abbreviated stabilized Omalizumab/mingraft VL (SEQ ID NO: 302).

Stabilized Omalizumab VL having all possible back mutations; abbreviated stabilized Omalizumab/maxgraft VL (SEQ ID NO: 303).

Another example of anti-human IgE antibody is the mouse antibody Bsw17 (Vogel M et al., (2004) J Mol Biol, 341(2): 477-89; mouse VH domain with SEQ ID NO: 304 and mouse VL domain with SEQ ID NO: 305).

Following the methods and work flow described in Example 2.1, humanized VH and VL domains for the humanized Bsw17 antibody are engineered via CDR grafting onto the VH3-23 and VK1 germline frameworks, respectively. The resulting VH3 based variable domains are further abrogated for Protein A binding using the G65S or N82aS substitutions (Kabat numbering) depending on their usage in a BEAT antibody format. Two stabilized VH and VL domains are investigated differing by their different degree of back mutations. Back mutations were identified from sequence alignments between the parent antibody variable domains and a CDR grafted VH3 and VK1 similar to the first prototype antibody and the approach described in Example 2.1. These CDR grafted variable domains have no back mutations and are referred to herein as mingrafts. These sequences were then further modified to include all the back mutations identified from the previous alignment and resulted in modified variable domain sequences referred to herein as maxgrafts. The resulting sequences are summarized below:

Stabilized Bsw17 VH having no back mutations; abbreviated stabilized Bsw17/mingraft VH (SEQ ID NO: 306).

Stabilized Bsw17 VH having all possible back mutations; abbreviated stabilized Bsw17/maxgraft VH (SEQ ID NO: 307).

Stabilized Bsw17 VL having no back mutations; abbreviated stabilized Bsw17/mingraft VL (SEQ ID NO: 308).

Stabilized Bsw17 VL having all possible back mutations; abbreviated stabilized Bsw17/maxgraft VL (SEQ ID NO: 309).

Example 3

Production of T Cell Retargeting Hetero-Dimeric Immunoglobulins 3.1 BEAT® Technology and Built-in Purification System BEAT antibodies are heavy chain hetero-dimers based on a unique concept of bio-mimicry that exhibit superior hetero-dimerization over the "knob-into-hole" technology (PCT publication No: WO2012131555). The BEAT platform is based on an exchange of interface amino acids at 3D equivalent positions between naturally occurring homo or hetero-dimeric immunoglobulin domain pairs to create new hetero-dimers that can be used as building blocks for Fc-based bispecific antibodies. The technology allows for the design of Fc-based bispecific antibodies using any type of antigen binding scaffold. A scFv-FAB format is used herein to design Fc-based bispecific antibodies without the need to develop a common light chain for both antigen binding sites.

Since BEAT antibodies are heavy chain hetero-dimers, it is needed to distinguish between the two different heavy chains. These are referred herein as BTA and BTB chains. BTA and BTB chains as used herein encompass an antigen binding site, a human IgG1 hinge region, a CH2 domain originating from human IgG1 or IgG3 isotype and a modified CH3 domain originating from human IgG1 or IgG3 isotype. Some of the BTA and BTB CH3 domains were identical or modified variants of the domains described in PCT Publication No: WO2012131555. BTA and BTB CH3 domains were selected from the groups consisting of: (BTA) SEQ ID NO: 147, 148, 149, 153, 154, and 155, and (BTB) SEQ ID NO: 150, 151, 152, 156, 157, and 158. Preferred BTA-BTB CH3 domain pairings are selected from the group consisting of: SEQ ID NO: 147 with SEQ ID NO: 150, SEQ ID NO: 148 with SEQ ID NO: 150, SEQ ID NO: 149 with SEQ ID NO: 151, SEQ ID NO: 147 with SEQ ID NO: 152, and SEQ ID NO: 148 with SEQ ID NO: 152. Most preferred BTA-BTB CH3 domain pairings are selected from the group consisting of: SEQ ID NO: 147 with SEQ ID NO: 156, SEQ ID NO: 148 with SEQ ID NO: 156, SEQ ID NO: 154 with SEQ ID NO: 150, and SEQ ID NO: 154 with SEQ ID NO: 152.

As described above, BEAT heavy chain hetero-dimers with an asymmetrical binding to Protein A can be created using parental domains from immunoglobulin isotypes having no binding to Protein A (PCT publication No: WO2012131555). A difference in the number of Protein A binding sites between homo- and hetero-dimeric species is particularly useful to resolve these molecular species by Protein A chromatography. To avoid a residual binding that will interfere with species separation by Protein A chromatography, it is necessary to abrogate any secondary Protein A binding sites which are naturally found within the VH3 subclass of human heavy chain variable domains. When antigen binding sites originate from the VH3 family, abrogation of their Protein A binding site can be achieved through the G65S or N82aS substitutions (Kabat numbering).

When preparing a bispecific antibody encompassed by the present invention, using one antigen binding site of VH3 origin and one antigen binding site from a non VH3 origin, the antigen binding site of VH3 origin needs to be located on the heavy chain that does bind Protein A in its Fc region. Alternatively, the antigen binding site of VH3 origin can be substituted with the N82aS substitution or G65S substitution or equivalent substitutions thereof to abrogate Protein A binding. When preparing a bispecific antibody from the present invention using a pair of antigen binding sites of VH3 origin, the only possibility is to abrogate Protein A binding in at least one of the VH3 based antigen binding sites through the amino acid substitutions described above. Preferably, bispecific antibodies from the present invention are engineered to create one of the two homo-dimer without Protein A binding site. More preferably, bispecific antibodies from the present invention are engineered to create one homo-dimer without Protein A binding site, and the other homo-dimer having a substantial difference in its number of Protein A binding sites (at least one Protein A binding site, preferably two Protein A binding sites) over the heterodimer of interest.

Mechanisms of toxicity triggered by monospecific anti-human CD3 epsilon antibodies have been under extensive investigation; direct mechanisms have been linked to affinity, epitope and valency of the antibodies but indirect mechanisms of toxicity have also been described. These indirect mechanisms of toxicity are mediated by the Fc region of the anti-human CD3 epsilon antibodies which interact with Fc receptor expressing immune cells and lead to transient T cell activation and cytokine release. With a goal to improve safety, BEAT antibodies targeting human CD3 epsilon were abrogated for Fc-receptor binding in their lower hinge region. Fc receptor binding was abrogated or reduced using the L234A and L235A substitutions (EU numbering; Strohl W R et al., (2009) Curr Opin Biotechnol, 20(6): 685-91); which are often referred as the LALA substitutions.

Figure 12A:
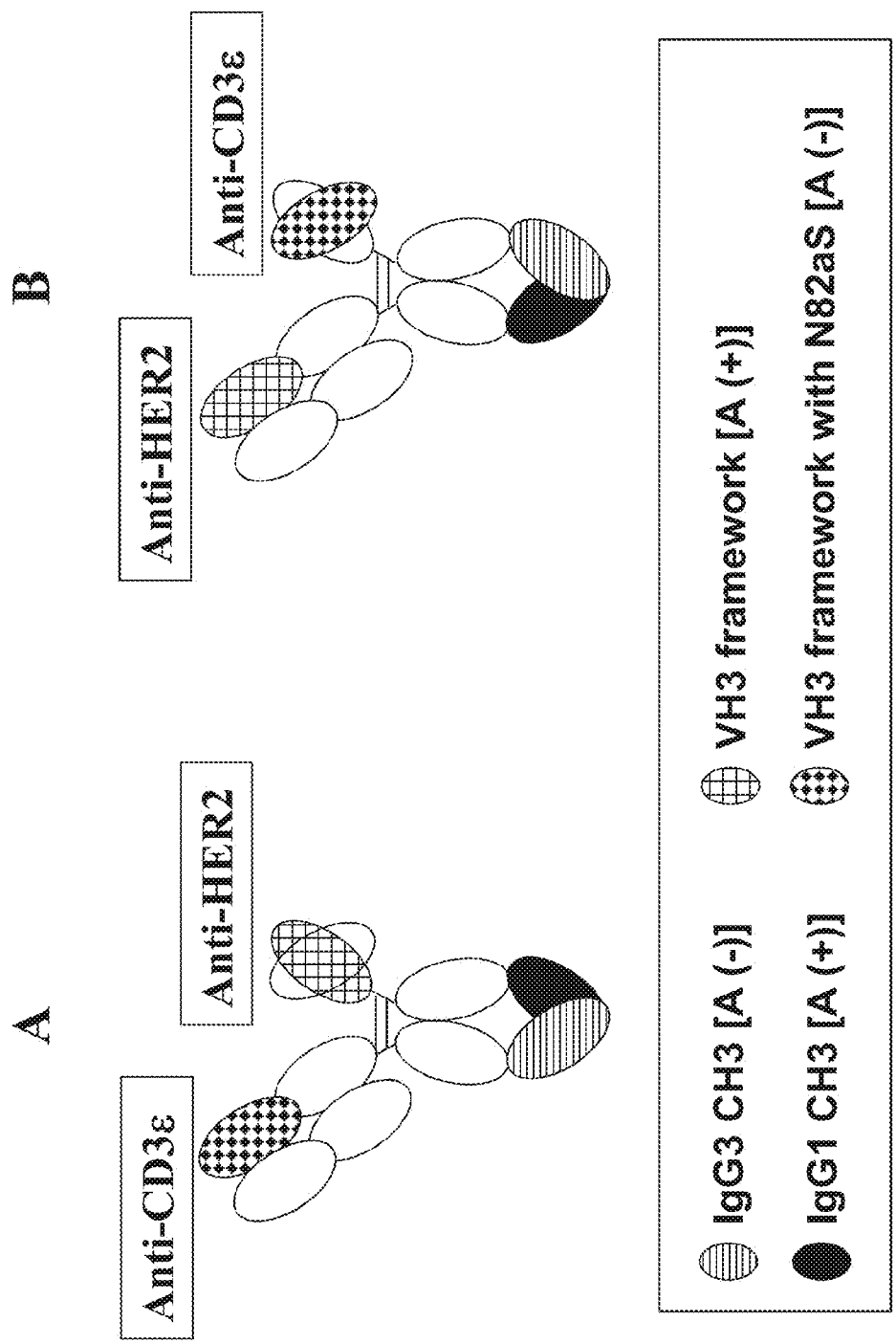
FIG. 12A-C: Schematic diagram of the BEAT HER2/CD3 antibodies in alternative formats.

Examples of BEAT Antibodies Encompassing at Least One VH3 Domain Abrogated for Protein A Binding
Examples of HER2/CD3 Targeting BEAT Antibodies Anti-HER2 and anti-CD3 epsilon arms can be formatted either as a scFv-Fc type of heavy chains consisting of a scFv fragment fused to a BEAT chain or as a heavy chain consisting of a FAB fragment fused to a BEAT chain similar to that of a naturally occurring antibody. The FAB based heavy chain requires its association with its cognate light chain to assemble into a functional antigen binding site. L234A and L235A substitutions were introduced in CH2 regions and residual Protein A binding was abrogated within using the G65S or N82aS substitutions (Kabat numbering) when appropriate. Examples of BEAT antibodies targeting both human HER2 antigen and human CD3 epsilon were formatted as follows:

A first BEAT HER2/CD3 antibody was engineered using a combination of antigen binding sites described in Example 2.1 and 2.2 for the anti-human CD3 epsilon and the anti-human HER2 arms, respectively. The anti-human CD3 epsilon arm of the hetero-dimeric immunoglobulin consisted of a BEAT heavy chain (SEQ ID NO: 159) encompassing a variable heavy chain region with the N82aS substitution (Kabat numbering), a CH1 γ1 region, a γ1 hinge region, a γ3 CH2 region with L234A and L235A substitutions (EU numbering), and a γ3 based BEAT CH3 domain assembled with its cognate light chain (SEQ ID NO: 47). This heavy chain encompassed part of a human IgG3 Fc region and therefore had no binding to Protein A but since the heavy chain used herein had its heavy chain variable domain originating from the VH3 domain subclass, the VH domain was mutated to include the N82aS substitution thereby removing any additional Protein A binding sites within the heavy chain. The anti-human HER2 arm of the hetero-dimeric immunoglobulin consisted of a BEAT heavy chain (SEQ ID NO: 160) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT HER2/CD3-1 antibody (FIG. 12A format A).

A second BEAT HER2/CD3 antibody was engineered using a combination of antigen binding sites described in Example 2.1 and 2.2 for the anti-human CD3 epsilon and the anti-human HER2 arms, respectively. The anti-human HER2 arm of the hetero-dimeric immunoglobulin consisted of a BEAT heavy chain (SEQ ID NO: 161) encompassing a variable heavy chain region, a CH1 γ1 region, a γ1 hinge region, a γ1 CH2 region with L234A and L235A substitutions (EU numbering), and a γ1 based BEAT CH3 domain assembled with its cognate light chain (SEQ ID NO: 3). The anti-human CD3 epsilon arm of the hetero-dimeric immunoglobulin consisted of a BEAT heavy chain (SEQ ID NO: 162) encompassing a scFv fragment, a CH1 γ1 region, a γ1 hinge region, a γ3 CH2 region with L234A and L235A substitutions (EU numbering), and a γ3 based BEAT CH3 domain. This heavy chain encompassed part of a human IgG3 Fc region and therefore had no binding to Protein A but since the heavy chain used herein had its heavy chain variable domain originating from the VH3 domain subclass, the VH domain was mutated to include the N82aS substitution thereby removing any additional Protein A binding sites within the heavy chain. This bispecific antibody is referred herein as BEAT HER2/CD3-2 antibody (FIG. 12A format B).

Figure 12B:
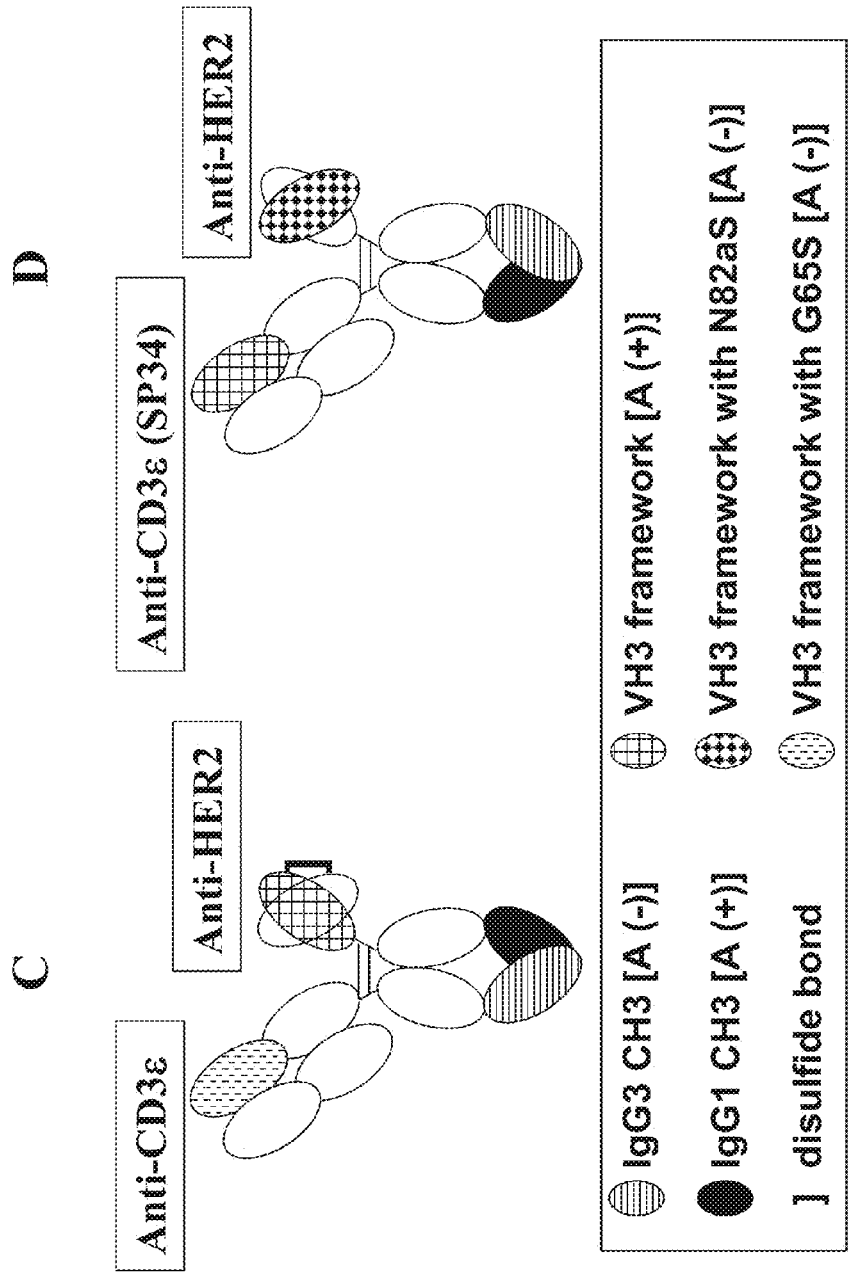

A third BEAT HER2/CD3 antibody was engineered using a combination of antigen binding sites described in Example 2.1 and 2.2 for the anti-human CD3 epsilon and the anti-human HER2 arms, respectively. The anti-human CD3 epsilon arm of the hetero-dimeric immunoglobulin consisted of a BEAT heavy chain (SEQ ID NO: 163) encompassing a variable heavy chain domain with the G65S substitution (Kabat numbering), a CH1 γ1 region, a γ1 hinge region, a γ3 CH2 region with L234A and L235A substitutions (EU numbering), and a γ3 based BEAT CH3 domain assembled with its cognate light chain (SEQ ID NO: 47). This heavy chain encompassed part of a human IgG3 Fc region and therefore had no binding to Protein A but since the heavy chain used herein had its heavy chain variable domain originating from the VH3 domain subclass, the VH domain was mutated to include the G65S substitution thereby removing any additional Protein A binding sites within the heavy chain. The anti-human HER2 arm of the hetero-dimeric immunoglobulin consisted of a BEAT heavy chain (SEQ ID NO: 164) encompassing a scFv fragment, a CH1 γ1 region, a γ1 hinge region, a γ1 CH2 region with L234A and L235A substitutions (EU numbering), and a γ1 based BEAT CH3 domain. The scFv portion of the bispecific antibody was further stabilised using an engineered disulfide bond between the heavy and light chain domains at Kabat position heavy chain 44 (G44C) and light chain 100 (Q100C) as described in PCT publication No WO 1994029350. This bispecific antibody is referred herein as BEAT HER2/CD3-3 antibody (FIG. 12B format C).

A fourth BEAT HER2/CD3 antibody was engineered using a combination of antigen binding sites described in Example 2.1 and 2.2 for the anti-human CD3 epsilon and the anti-human HER2 arms, respectively. The anti-human CD3 epsilon arm of the hetero-dimeric immunoglobulin consisted of a BEAT heavy chain (SEQ ID NO: 165) encompassing a variable heavy chain domain, a CH1 γ1 region, a γ1 hinge region, a γ1 CH2 region with L234A and L235A substitutions (EU numbering), and a γ1 based BEAT CH3 domain assembled with its cognate light chain (SEQ ID NO: 166). This heavy chain and light assembly encompassed a humanized version of the anti-human CD3 epsilon antibody (SP34) as described in PCT Publication No: WO2008119565. The anti-human HER2 arm of the hetero-dimeric immunoglobulin consisted of a BEAT heavy chain (SEQ ID NO: 167) encompassing a scFv fragment, a CH1 γ1 region, a γ1 hinge region, a γ3 CH2 region with L234A and L235A substitutions (EU numbering), and a γ3 based BEAT CH3 domain. This heavy chain encompassed part of a human IgG3 Fc region and therefore had no binding to Protein A but since the heavy chain used herein had its heavy chain variable domain originating from the VH3 domain subclass, the VH domain was mutated to include the N82aS substitution thereby removing any additional Protein A binding sites within the heavy chain. This bispecific antibody is referred herein as BEAT HER2/CD3(SP34) antibody (FIG. 12B format D).

Figure 12C:
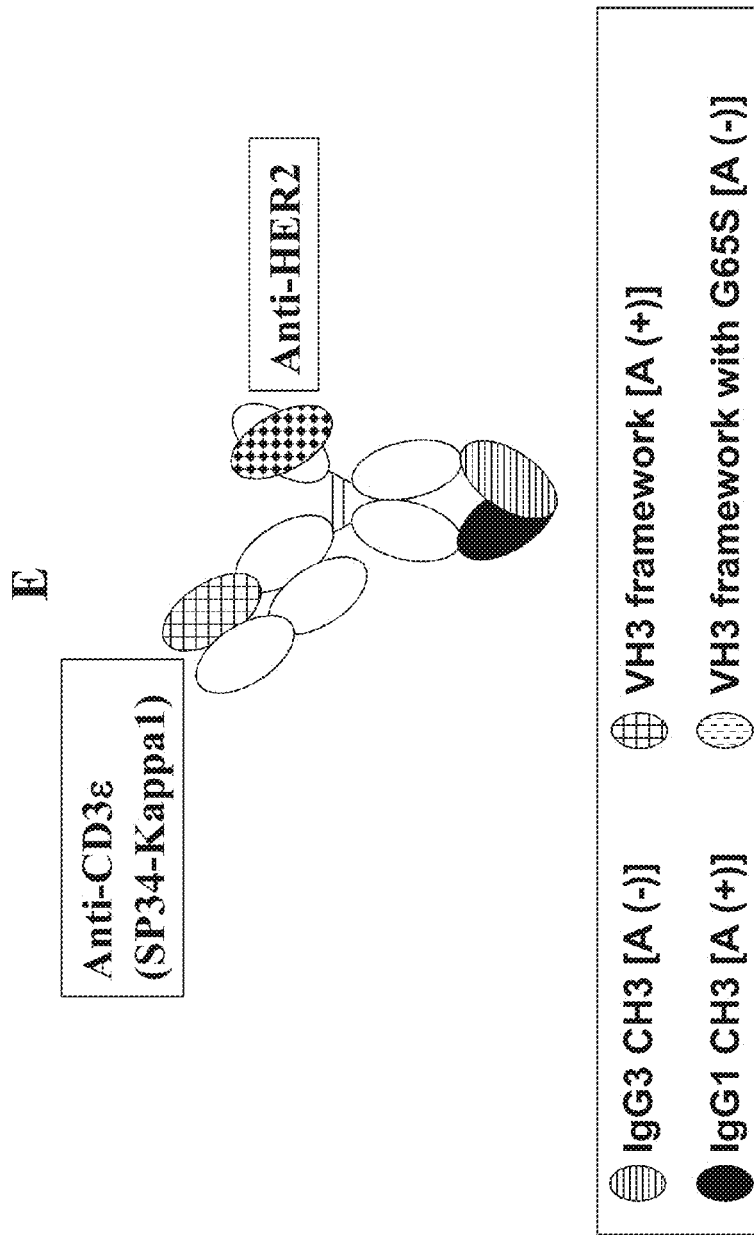

A fifth BEAT HER2/CD3 antibody was engineered using a combination of antigen binding sites described in Example 2.1 and 2.2 for the anti-human CD3 epsilon and the anti-human HER2 arms, respectively. The anti-human CD3 epsilon arm of the hetero-dimeric immunoglobulin consisted of a BEAT heavy chain (SEQ ID NO: 168) encompassing a variable heavy chain domain, a CH1 γ1 region, a γ1 hinge region, a γ1 CH2 region with L234A and L235A substitutions (EU numbering), and a γ1 based BEAT CH3 domain assembled with its cognate light chain (SEQ ID NO: 89). This arm of the bispecific antibody encompassed the variable domains of the humanized SP34 VH1/VL21 antibody described in Example 2.1. The anti-human HER2 arm of the hetero-dimeric immunoglobulin consisted of a BEAT heavy chain (SEQ ID NO: 167) encompassing a scFv fragment, a CH1 γ1 region, a γ1 hinge region, a γ3 CH2 region with L234A and L235A substitutions (EU numbering), and a γ3 based BEAT CH3 domain. This arm is equivalent to the BEAT HER2/CD3(SP34) anti-HER2 arm described above (see FIG. 12B format D). The heavy chain encompassed part of a human IgG3 Fc region and therefore had no binding to Protein A but since the heavy chain used herein had its heavy chain variable domain originating from the VH3 domain subclass, the VH domain was mutated to include the N82aS substitution thereby removing any additional Protein A binding sites within the heavy chain. This bispecific antibody is referred herein as BEAT HER2/CD3(SP34-Kappa1) antibody (FIG. 12C format E).

Figure 2B:
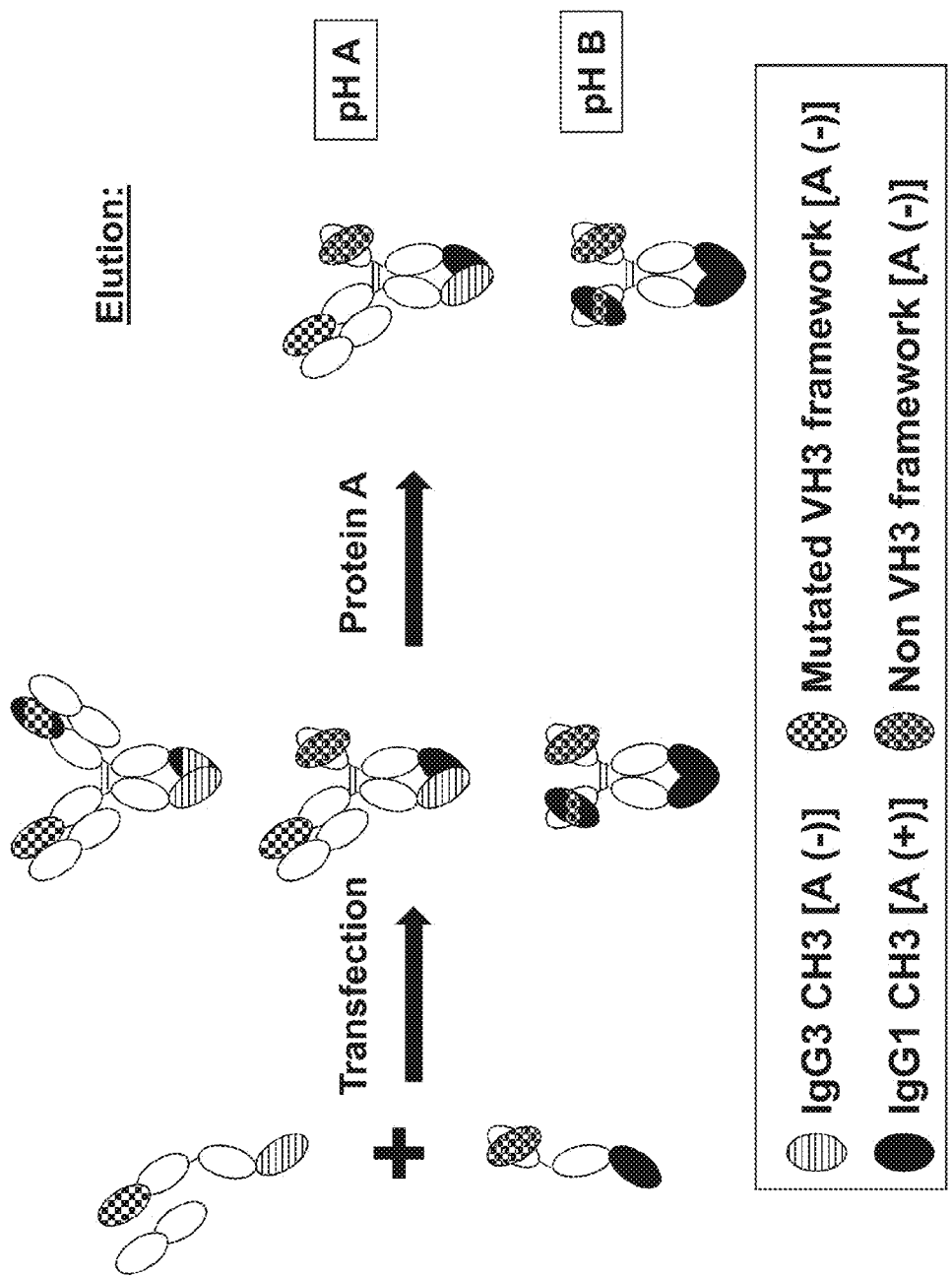
Figure 2D:
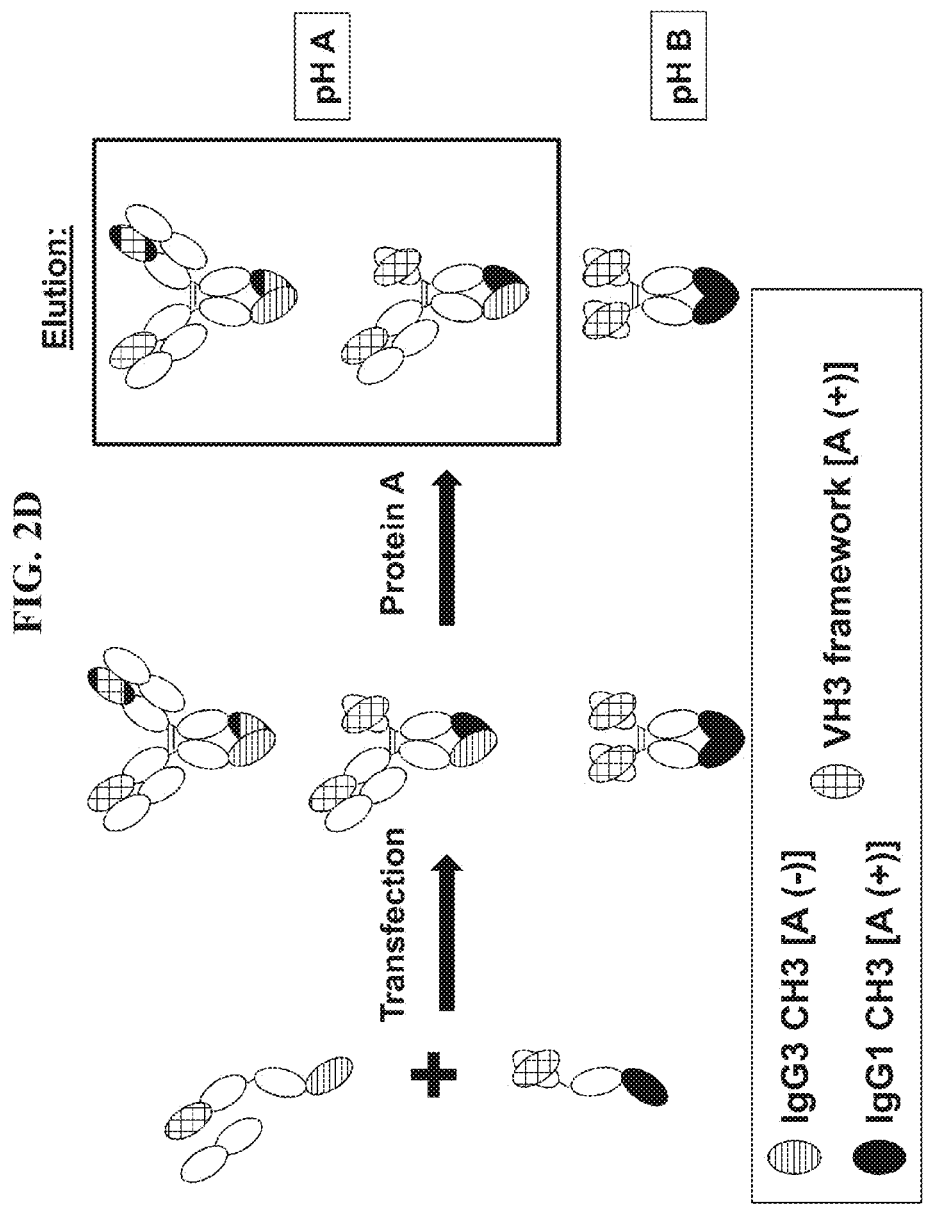
Figure 2E:
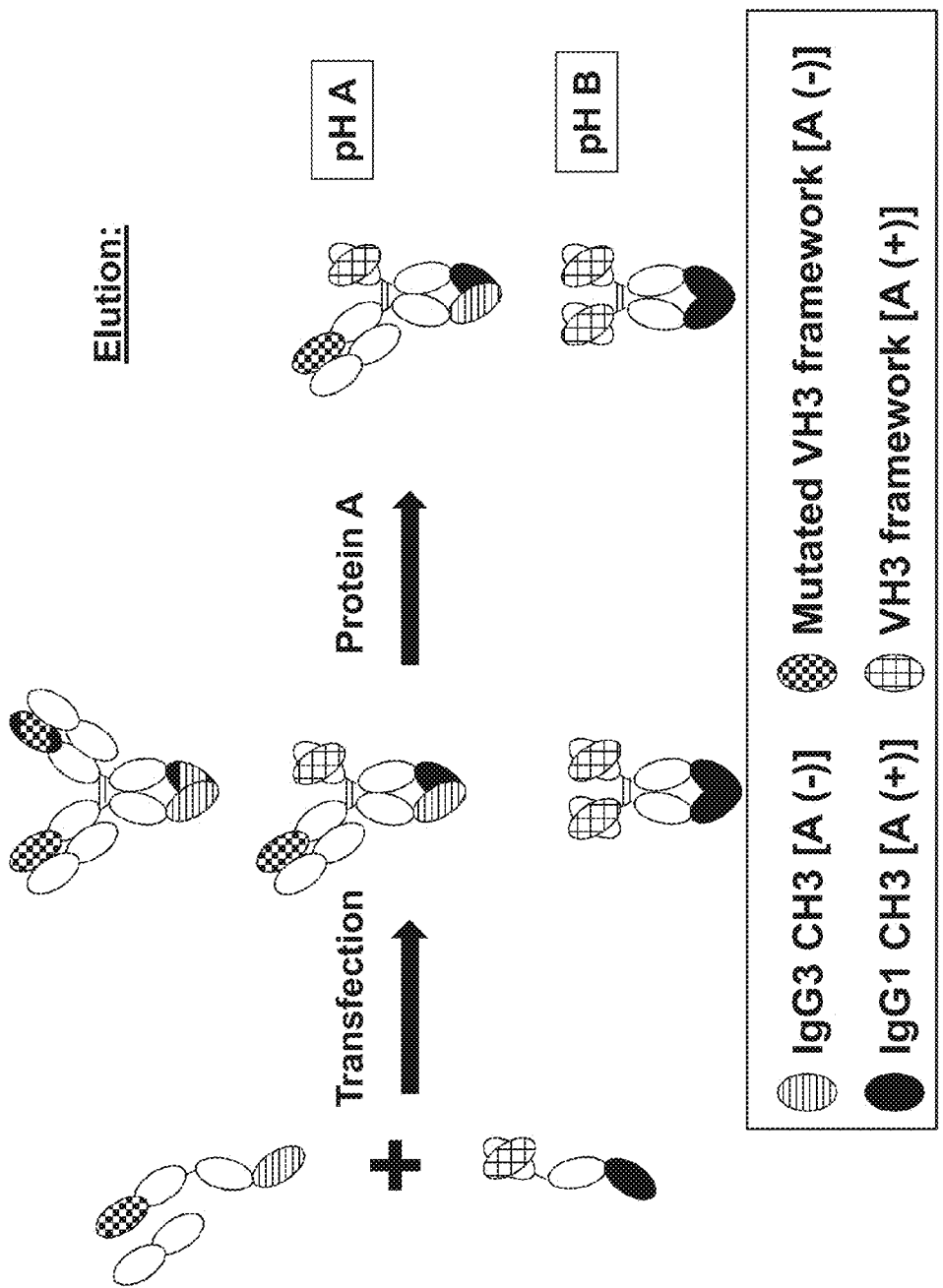
Figure 13:
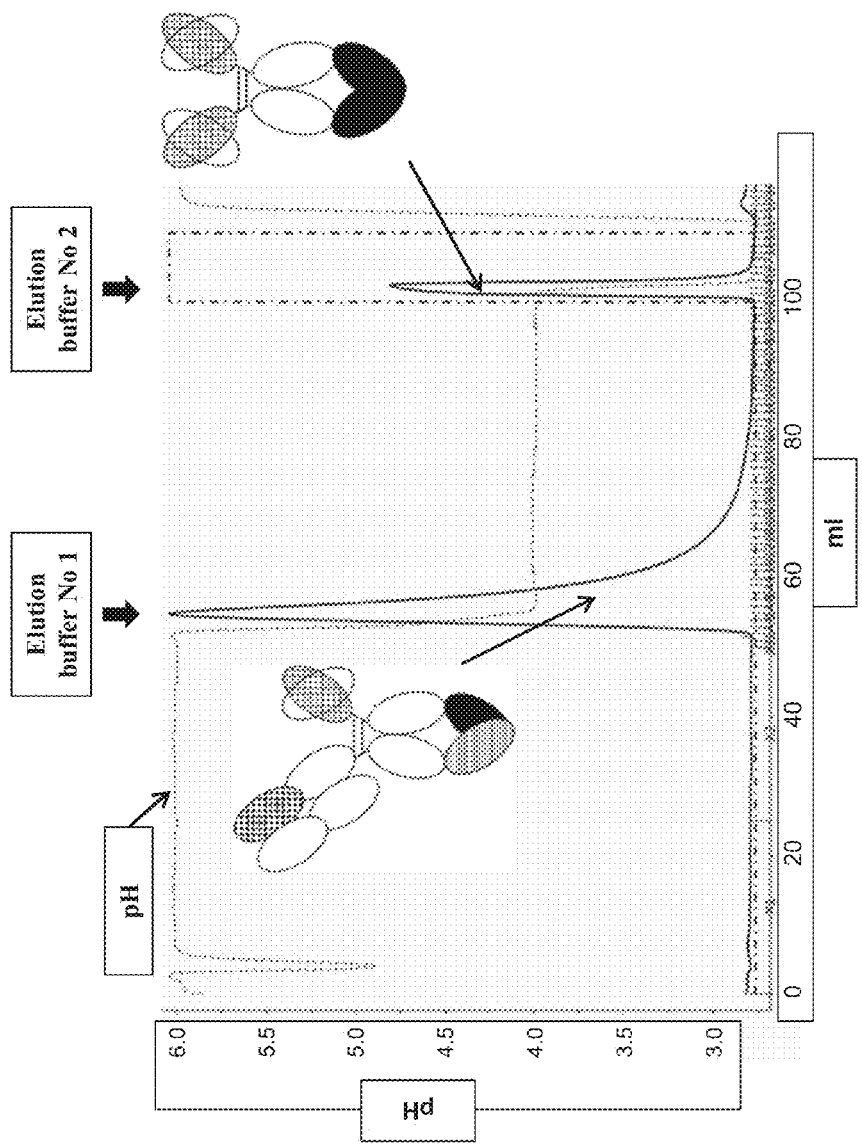
FIG. 13: Protein A purification profile of BEAT HER2/CD3-1 antibody (Absorbance trace at 280 nm). Column: 1 ml MabSelect SuRe. Flow rate: 1 mL/min. Running buffer: 0.2 M NaH$_2$PO$_4$ pH 6. Elution buffer No 1: 20 mM Na Acetate pH 4 (20 ml). Elution buffer No 2: 0.1 M Glycine pH 3 (20 ml). Neutralization: ⅒ vol. of 1M Tris pH 8.
Figure 14:
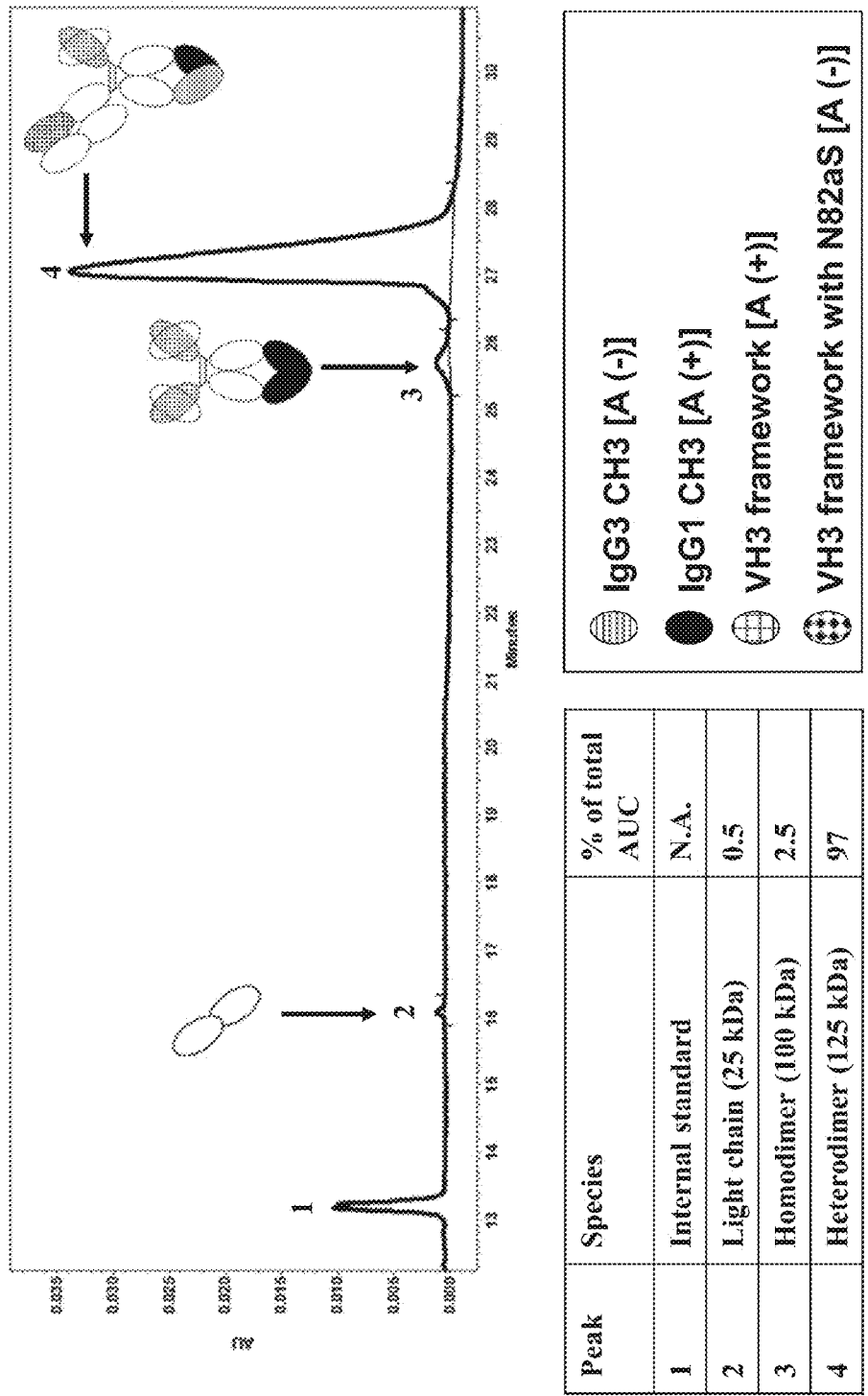
FIG. 14: Capillary Electrophoresis profile of BEAT HER2/CD3-1 antibody preparations.

BEAT HER2/CD3-1, BEAT HER2/CD3-2, BEAT HER2/CD3-3, BEAT HER2/CD3(SP34), and BEAT HER2/CD3 (SP34-Kappa1) antibodies were expressed transiently, purified and tested in vitro for their affinity towards the HER2 and CD3 epsilon antigens, their stability and their ability to redirect T cell killing. Transient expression yields were in the range of 5-15 mg/l of culture supernatant for all BEAT antibodies. Importantly, all bispecific antibodies exhibited very low level of homo-dimeric contaminants in their preparation after a single Protein A chromatography step. Since all these BEAT antibodies were designed with both arm encompassing a VH3 domain, only abrogation of Protein A binding in at least one VH3 domain allowed to readily purify the hetero-dimer of interest using the one of the preferred differential purification method (see FIG. 2E). An example of differential Protein A purification trace for the BEAT HER2/CD3-1 antibody is shown in FIG. 13, and FIG. 14 shows the capillary electrophoresis profile of the purified hetero-dimer. Only a marginal content of homo-dimeric contaminants can be identified from this profile. Homo-dimers of the heavy chain formatted to carry a FAB portion are not found since these do not bind Protein A. Homo-dimers of the heavy chain formatted to carry the scFv fragments are found in a marginal proportion (2.5%), resulting in a hetero-dimer content of 97% after a single Protein A chromatography step. BEAT HER2/CD3-2, BEAT HER2/CD3-3, BEAT HER2/CD3(SP34), and BEAT HER2/CD3 (SP34-Kappa1) antibodies purified to similar levels of homogeneity and purity after a single Protein A chromatography step. The BEAT HER2/CD3-3 antibodies showed a proportion of disulfide bonded hetero-dimer aggregates after Protein A chromatography (27%) that were removed by cation exchange chromatography.

Figure 15A:
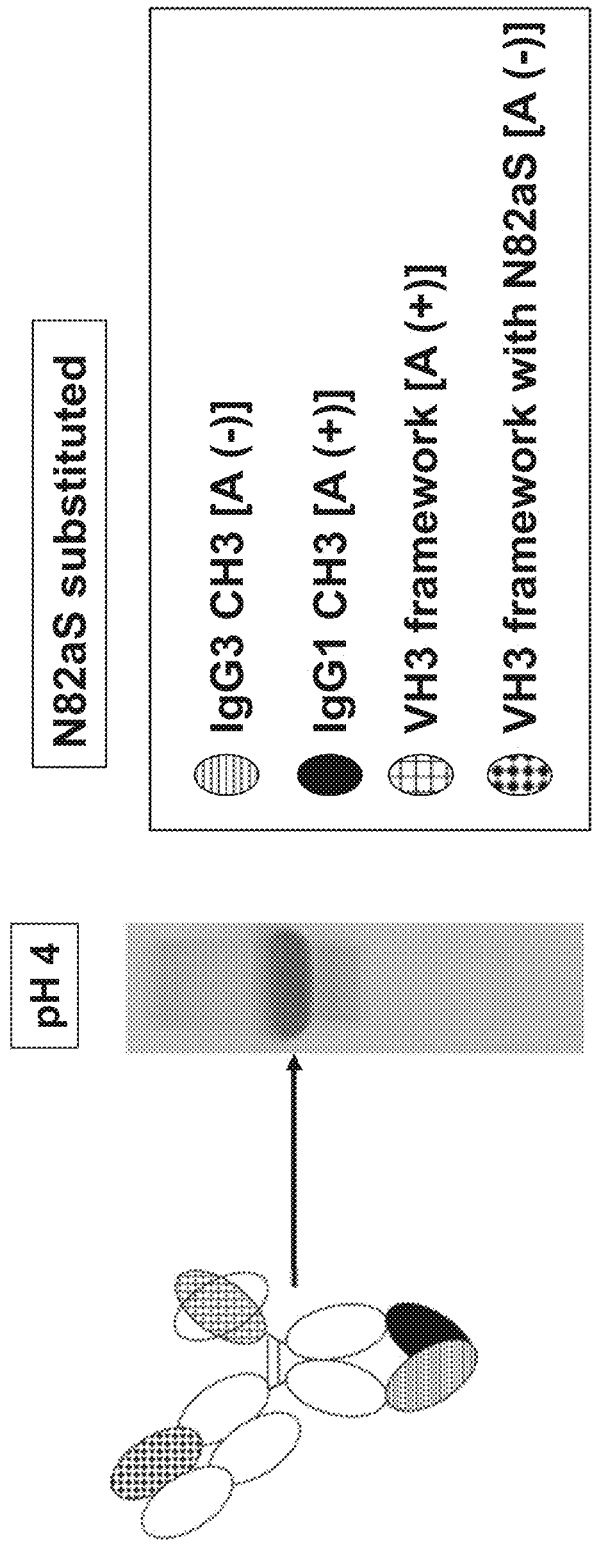
FIG. 15A: SDS-PAGE analysis of N82aS substituted BEAT HER2/CD3-1 antibody.
Figure 15B:
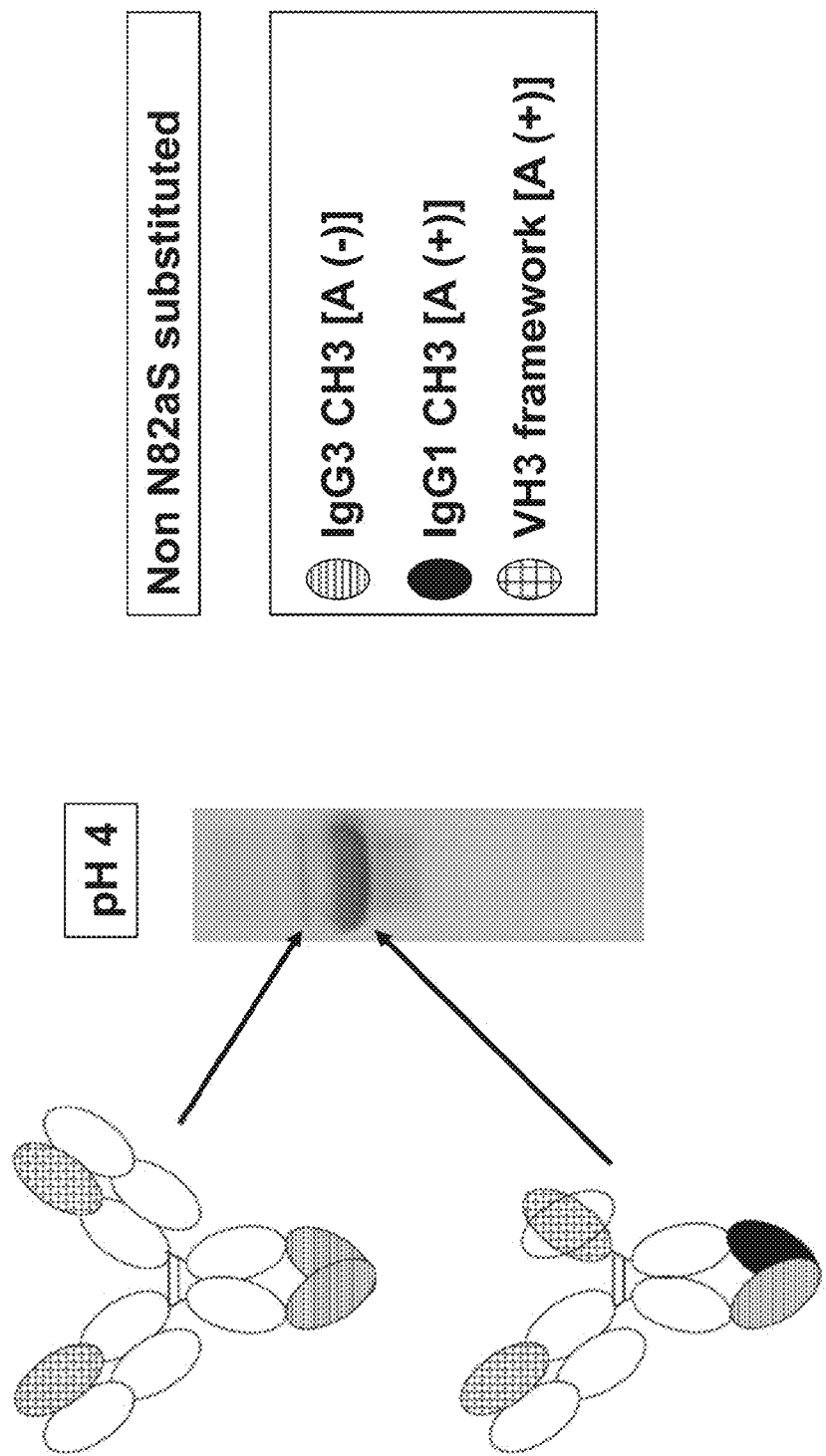
FIG. 15B: SDS-PAGE analysis of N82aS non substituted BEAT HER2/CD3-1 antibody variant. Legend: [(A+)] means a functional Protein A binding site and [(A−)] means a nonfunctional Protein A binding site. pH of elution is indicated.

To further demonstrate that abrogation of Protein A binding within VH3 based heavy chain hetero-dimers greatly impacts on post Protein A chromatography purity, a BEAT HER2/CD3-1 antibody was engineered without the aforementioned N82aS substitution. FIGS. 15A and 15B show the SDS-PAGE analysis of eluted Protein A chromatography fractions for the BEAT HER2/CD3-1 and its non N82aS substituted version, respectively. At pH 4, the eluted fraction for the non N82aS substituted version exhibits an additional band corresponding to homo-dimers of the heavy chain formatted to carry a FAB arm (FIG. 15B) while the N82aS substituted BEAT HER2/CD3 version does not (FIG. 15A), since the heavy chain formatted to carry a FAB arm has no binding to Protein A in its Fc region (Fc region based on human IgG3 isotype), it can only be deduced that the VH3 based variable domains found in this homo-dimeric species are responsible for Protein A binding. This result clearly demonstrates the utility of abrogating Protein A binding within VH3 based heavy chain hetero-dimers.

Figure 16C:
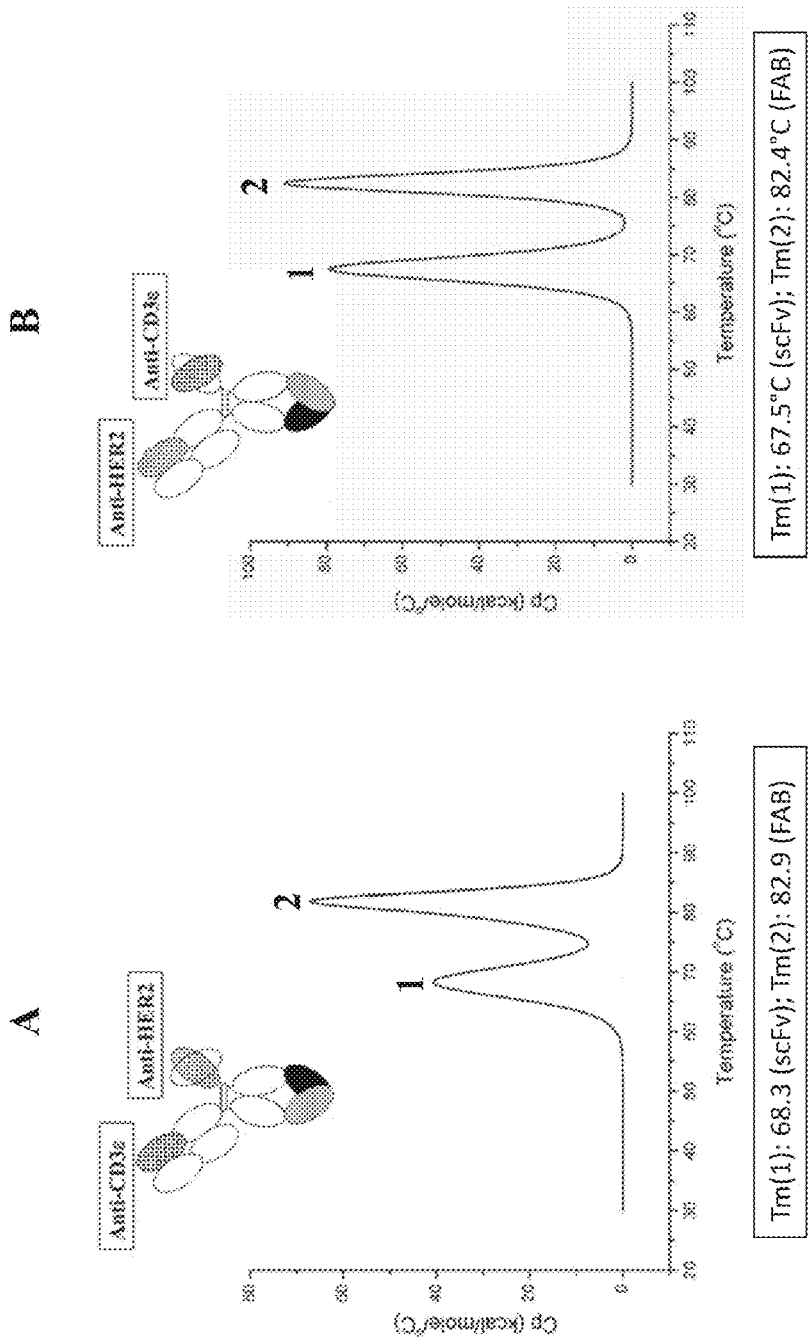
FIG. 16C: DSC profiles of BEAT HER2/CD3-1 and -2 antibodies shown in profiles A and B, respectively.

Both BEAT HER2/CD3-1 and BEAT HER2/CD3-2 antibodies had similar KD values for the human HER2 and human CD3 epsilon antigens. KD values were in the range of 0.50-2 nM for the human HER2 antigen and 1-2 μM for the human CD3 epsilon antigen (measured by SPR using the human CD3gamma-epsilon-Fc construct (see Materials and Methods section; FIGS. 16A and 16B). DSC profiles for the two bispecific antibodies were similar, in both case the scFv portions either engaging human HER2 or human CD3 epsilon had retained their good thermo-stability profiles with Tm in the range of 68° C. FAB portions in both antibodies had Tm in the range of 82-83° C. (FIG. 16C).

Another example of BEAT antibodies targeting both human HER2 antigen and human CD3 epsilon using the humanized Herceptin VH and VL sequences is formatted as follows: a BEAT HER2/CD3 is engineered using a combination of antigen binding sites described in Example 2.1 and 2.2 for the anti-human CD3 epsilon and the anti-human HER2 antigen binding sites, respectively. The anti-human HER2 arm of the hetero-dimeric immunoglobulin consists of a BEAT heavy chain (SEQ ID NO: 310) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 3). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain.

The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT HER2/CD3(SP34-Kappa2) antibody.

In Vitro T Cell Killing Assays

The mechanism of action of BEAT HER2/CD3 antibodies is based on targeting cytotoxic T cell killing towards targeted cells by bridging the CD3 antigen on the cell surface of cytotoxic T cells and the HER2 antigen expressed on targeted cells.

The potency of BEAT HER2/CD3-1 and BEAT HER2/CD3-2 antibodies to redirect T cell killing was measured using a flow cytometry based method (referred herein as RDL-FACS method) or a colorimetric based method (referred herein as RDL-MTS method). The high expressing HER2 cell line JIMT-1, a Herceptin® (trastuzumab) resistant breast carcinoma cell line, the high expressing HER2 cell line BT-474, a Herceptin® (trastuzumab) sensitive breast carcinoma cell line and the low HER2 expressing breast adenocarcinoma cell line MDA-MB-231 were individually cultured during 48 h in the presence of human PBMCs and serial dilutions of BEAT HER2/CD3-1 or -2 antibodies or control antibodies. In these assays, human PBMCs from blood donations were used a source of cytotoxic T lymphocytes. An effector to target cells ratio of 10:1 was used in all assays. Negative controls were provided in the form of samples without antibody treatment (target cells and human PBMCs only). The cytotoxicity was determined using the RDL-FACS or RDL-MTS methods after the incubation period (see Materials and Methods section). The results showed that control antibodies did not trigger specific T cell-mediated cytotoxicity. In contrast BEAT HER2/CD3-1 and -2 antibodies induced a very potent, dose dependent, tumor target cell death. Maximum killing was close to 100%. Both readout methods gave close results. Donor-to-donor variability accounted for about a tenfold different in $EC_{50}$ between the methods. Measured $EC_{50}$s correlated to the level of HER2 antigen expression by the target cell lines.

Figure 17A:
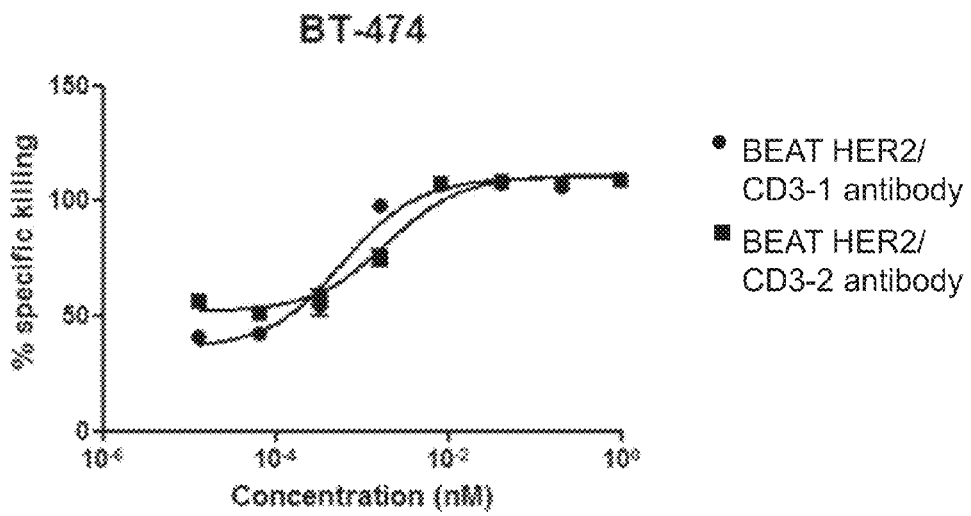
FIG. 17A-G: Examples of T cell redirected killing by the BEAT HER2/CD3 antibodies. Readout: RDL-MTS method. Effector cells: human PBMCs. Effector cells-to-targeted cells ratio of 10:1. Means of three donors with 48 h incubation. Antibody concentrations are shown in nM.
Figure 17B:
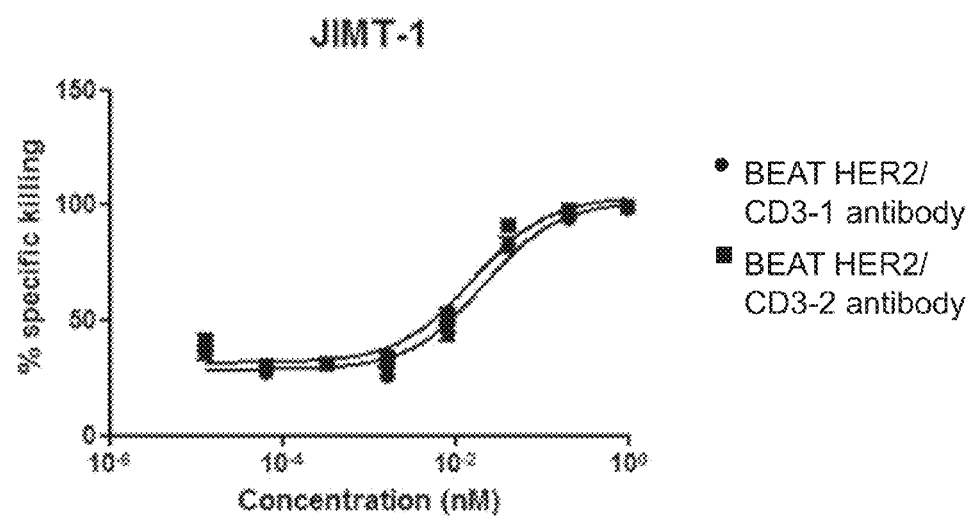
Figure 17C:
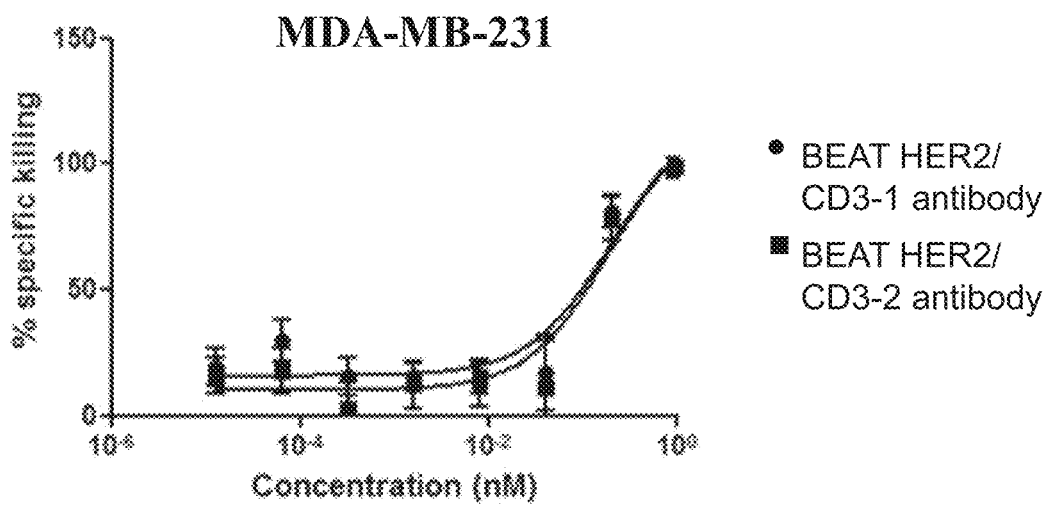

BT-474 cells express the most HER2 antigen and $EC_{50}$s for both BEAT HER2/CD3-1 and -2 antibodies were in the sub-picomolar to picomolar range (0.6 and 2 pM, respectively, FIG. 17A). JIMT-1 cells have masked HER2 antigen on their cell surface (Nagy P et al. (2005), Cancer Res, 65(2): 473-482) and consequently exhibit low Herceptin® binding in spite of having high HER2 expression. Surprisingly, both BEAT HER2/CD3-1 and -2 antibodies had $EC_{50}$s in the picomolar range against JIMT-1 cells as measured by the RDL-MTS method (21 and 16 pM, respectively; FIG. 17B). When measured with the RDL-FACS method, the BEAT HER2/CD3-1 antibody had an $EC_{50}$ of 1.4 pM. Low HER2 expressing breast adenocarcinoma cell line MDA-MB-231 was less sensitive than the previous two cell lines with both antibodies exhibiting sub-nanomolar $EC_{50}$s (both values close to 0.2 nM; FIG. 17C). When measured with the RDL-FACS method, the BEAT HER2/CD3-1 antibody had an $EC_{50}$ of 0.08 nM. Taken together, these results show that BEAT HER2/CD3-1 and -2 antibodies were highly potent at redirecting T cell killing against various HER2 expressing breast cancer cell lines.

Figure 17D:
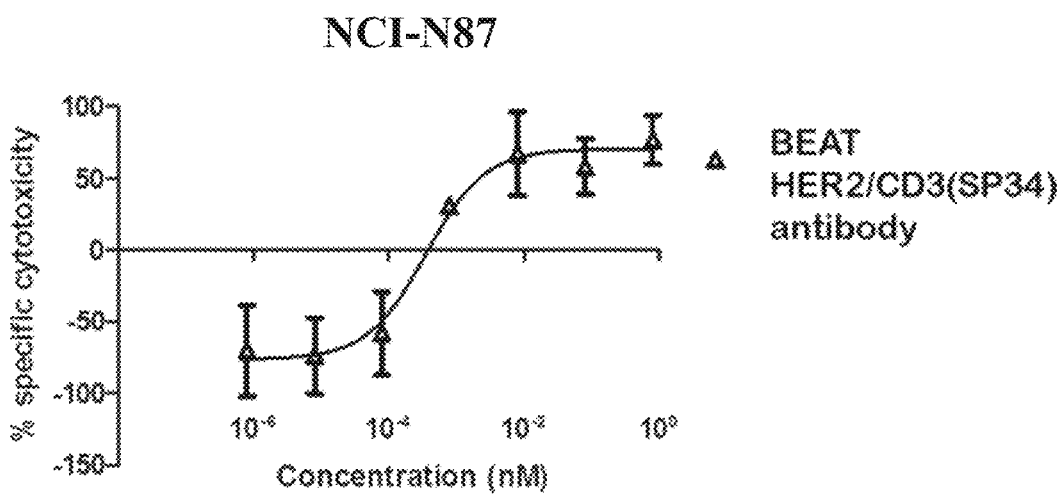
Figure 17E:
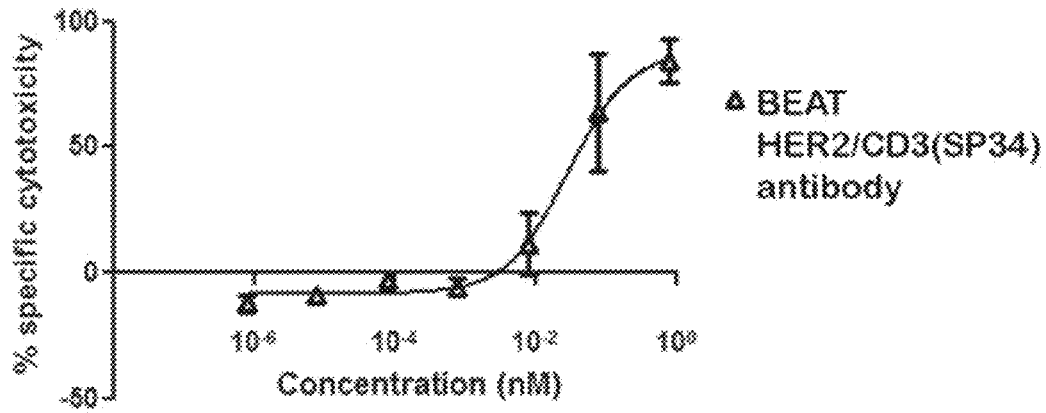

The BEAT HER2/CD3(SP34) antibody encompassed a humanized version of the anti-human CD3 epsilon antibody (SP34) described in PCT Publication No: WO2008119565. The ability of this BEAT antibody format to redirect T cell killing towards HER2+ cells was investigated in vitro. Two different HER2+ cell lines were used in killing assays, a high HER2 expressing cell line (NCI-N87) and a low HER2 expressing cell line (HT-1080) (See Materials and Methods section). FIG. 17D-E show T cell redirected killing of NCI-N87 and HT-1080 cells by the BEAT HER2/CD3 (SP34) antibody, respectively. The assays used an effector cells to target cells ratio of 10 to 1, and the RDL-MTS readout method after a 48 h incubation period (see Materials and Methods section). The results show that the BEAT HER2/CD3(SP34) antibody was highly potent at redirecting T cell killing against HER2+ cell lines with $EC_{50}$s of 0.35 and 29 pM when targeting NCI-N87 and HT-1080 cells, respectively.

Figure 17F:
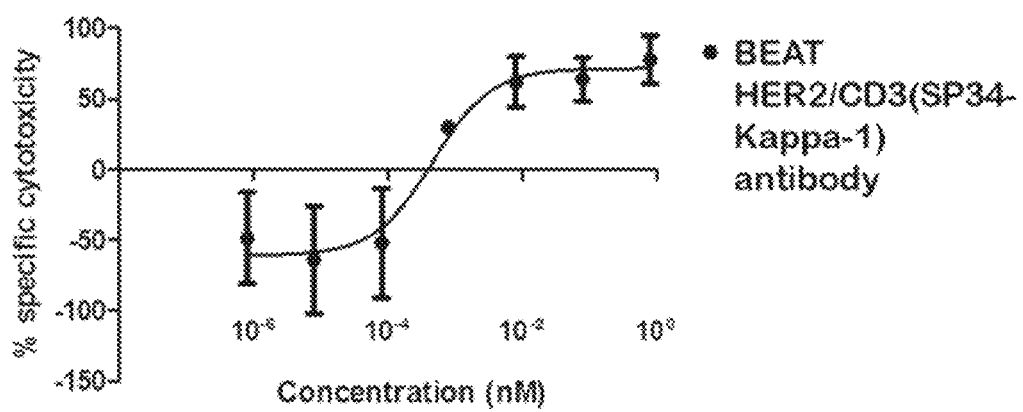
Figure 17G:
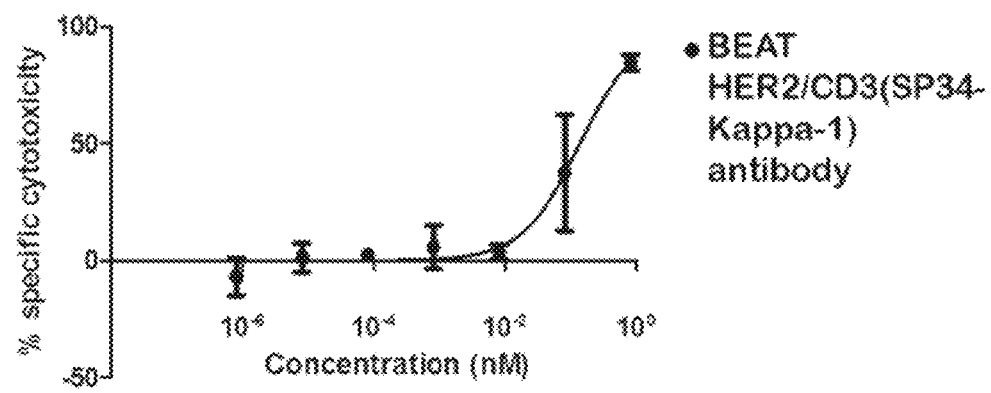

The BEAT HER2/CD3(SP34-Kappa1) antibody encompassed the humanized version of the anti-human CD3 epsilon antibody (SP34-Kappa1) VH1/VL21 described in Example 2.1. The ability of this BEAT antibody format to redirect T cell killing towards HER2+ cells was investigated in vitro. Two different HER2+ cell lines were used in killing assays, a high HER2 expressing cell line (NCI-N87) and a low HER2 expressing cell line (HT-1080) (See Materials and Methods section). FIG. 17F-G show T cell redirected killing of NCI-N87 and HT-1080 cells by the BEAT HER2/CD3(SP34-Kappa1) antibody, respectively. The assays used an effector cells to target cells ratio of 10 to 1, and the RDL-MTS readout method after a 48 h incubation period (see Materials and Methods section). The results show that the BEAT HER2/CD3(SP34-Kappa1) antibody was highly potent at redirecting T cell killing against HER2+ cell lines with $EC_{50}$s of 0.46 and 338 pM when targeting NCI-N87 and HT-1080 cells, respectively.

In Vivo Efficacy Studies

JIMT-1 Xenografts

The in vivo efficacy of the BEAT HER2/CD3-1 antibody was investigated using a JIMT-1/PBMC xenograft model. Human PBMCs from blood donations were used a source of cytotoxic T lymphocytes. Hercepting resistant breast carcinoma JIMT-1 cells were mixed at a 1:1 ratio with non-stimulated human PBMCs (four different donors) and subsequently injected subcutaneously in immunodeficiency (NOD/SCID) mice. Following engraftment, animals were treated with the BEAT HER2/CD3-1 antibody intravenously three times per week during two weeks. Antibody treatment started 3 hours after engraftment and continued on day 2, 4, 7, 9 and 11 thereafter.

To assess tumour growth without PBMCs, one cohort out of five was inoculated subcutaneously with 5×10e6 JIMT-1 cells in the absence of human PBMCs, whereas the remaining cohorts were subcutaneously injected with mixtures of 5×10e6 JIMT-1 cells mixed with 5×10e6 non-stimulated human PBMCs from healthy donors.

Figure 18A:
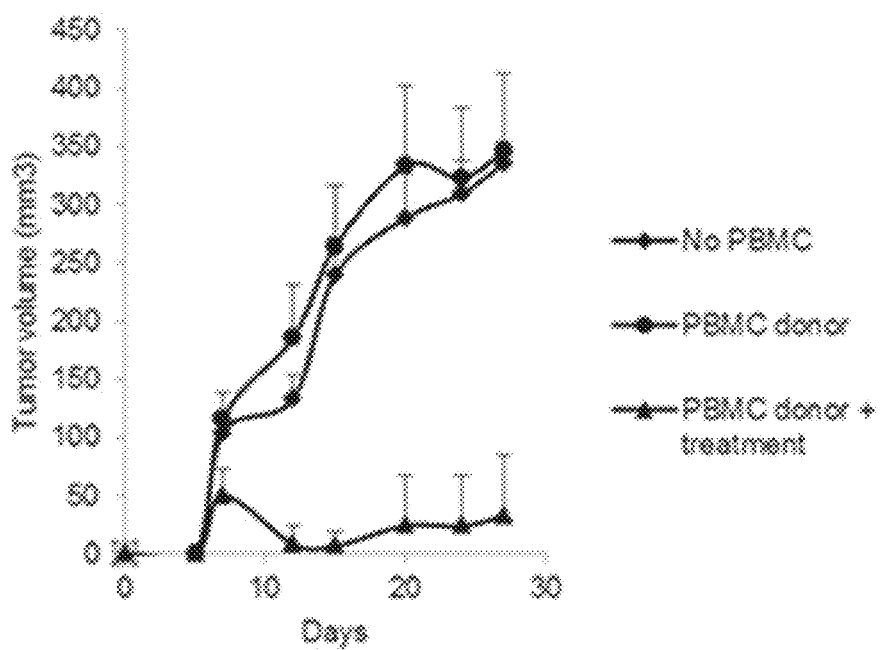
FIG. 18A-C: JIMT-1 xenografts with human PBMC supplementation.
Figure 18B:
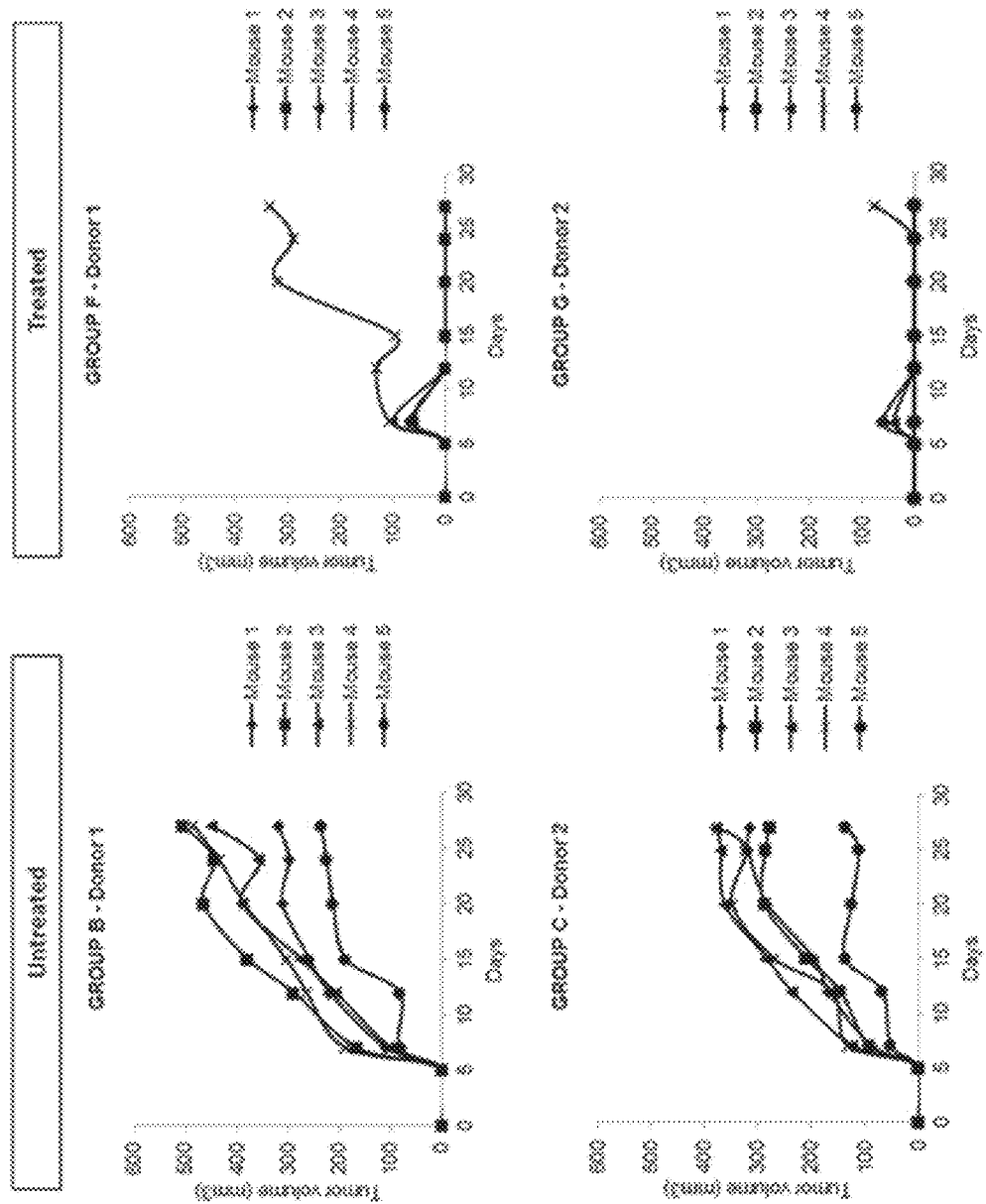
Figure 18C:
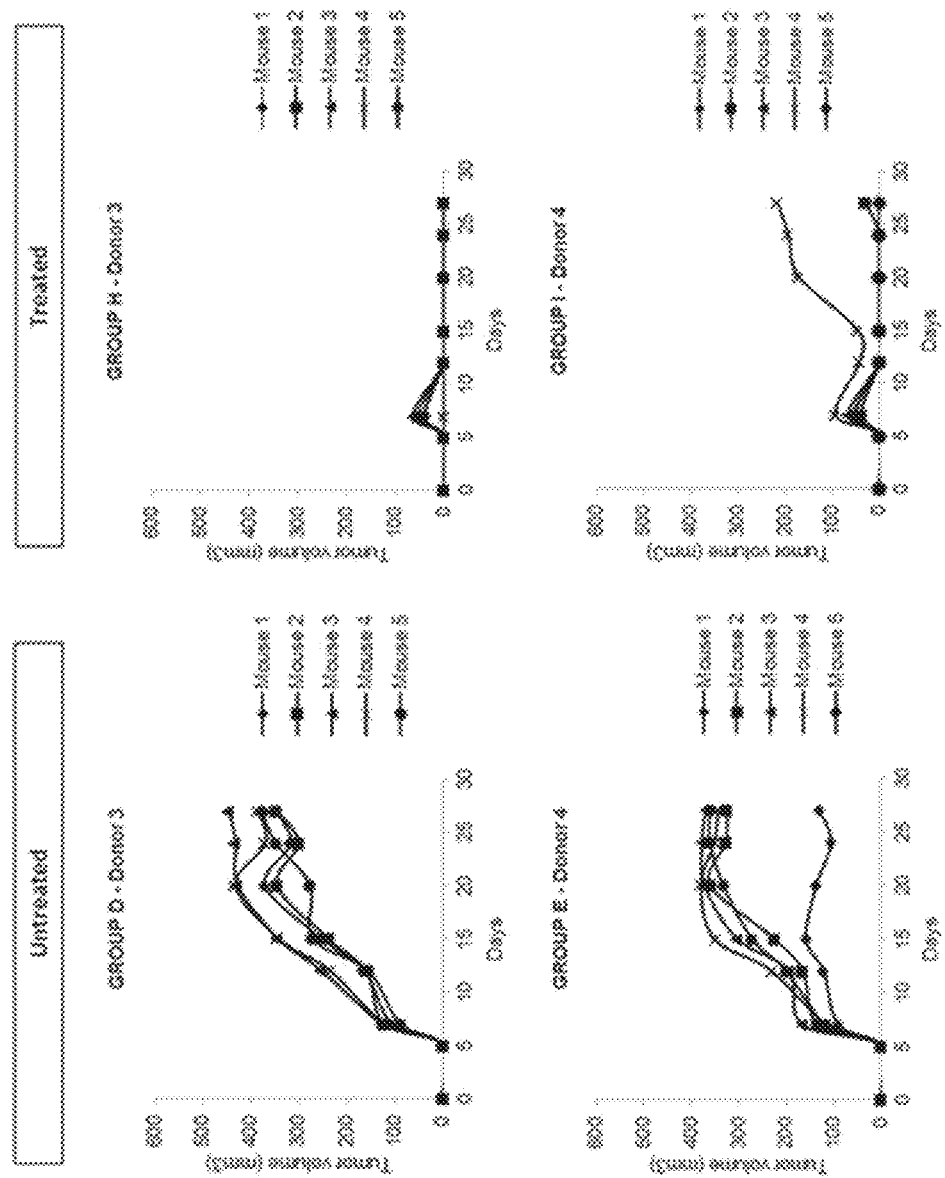

Human PBMCs, in the absence of antibody did not show a negative effect on tumour growth (FIG. 18A). Treatment with the BEAT HER2/CD3-1 antibody, in the presence of human effector cells induced a complete suppression of tumour growth in most of the animals (18/20 tumours, FIG. 18B-C). Eighteen days after the last day of treatment, only 11% of tumours (2/18) started to grow again. These data show very clearly the potent antitumor efficacy of the BEAT HER2/CD3-1 antibody.

Examples of CD38/CD3 Targeting BEAT Antibodies

Figure 19:
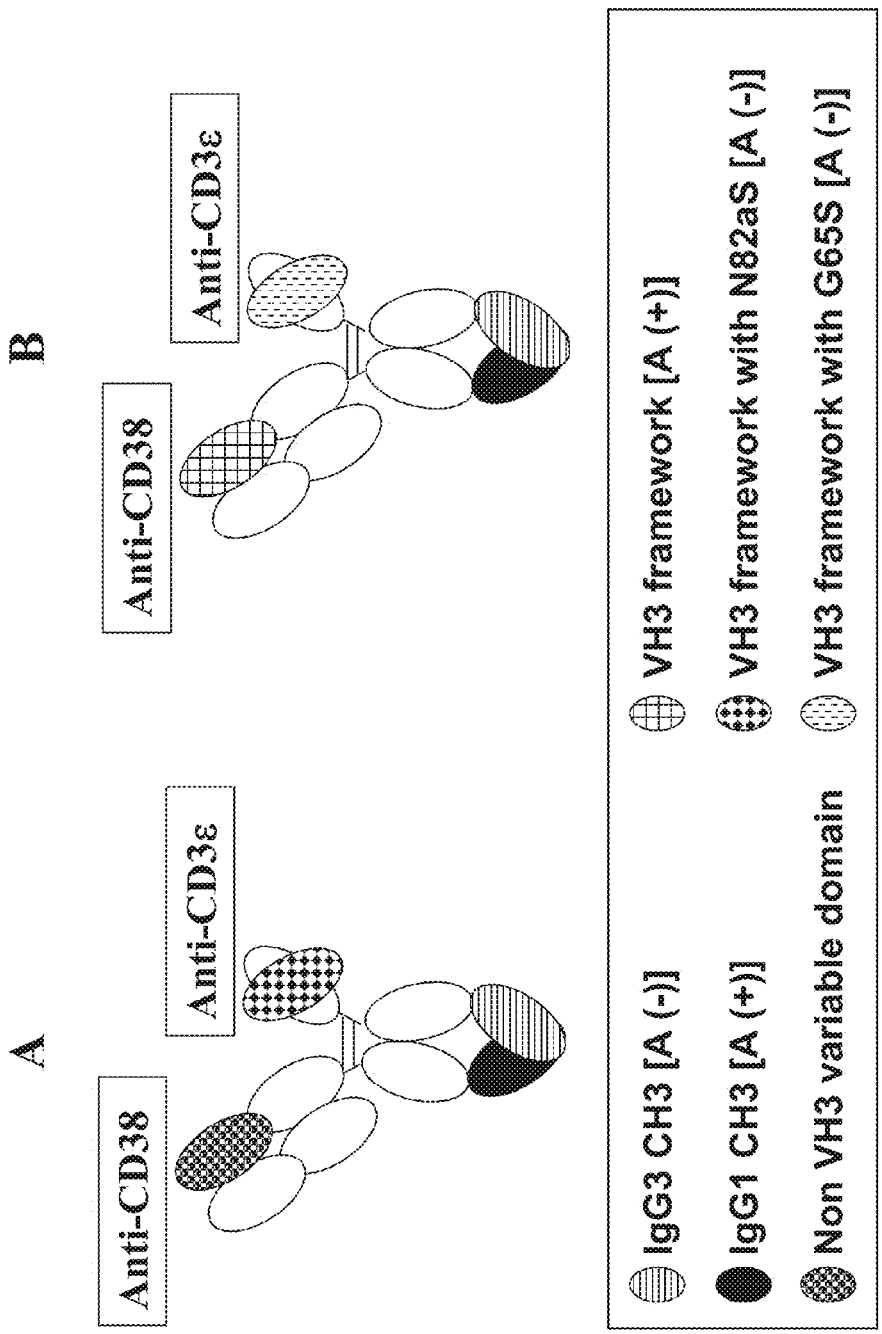
FIG. 19: Schematic diagram of the BEAT CD38-HB7bestfit/CD3 (format A) and BEAT CD38-767/CD3 (format B) antibodies. [(A+)] means functional Protein A binding site. [(A−)] means nonfunctional Protein A binding site.

Anti-CD38 and anti-CD3 epsilon arms can be formatted either as a scFv-Fc type of heavy chains consisting of a scFv fragment fused to a BEAT chain or as a heavy chain consisting of a FAB fragment fused to a BEAT chain similar to that of a naturally occurring antibody. The FAB based heavy chain requires its association with its cognate light chain to assemble into a functional antigen binding site. L234A and L235A substitutions were introduced in CH2 regions and residual Protein A binding was abrogated within using the G65S or N82aS substitutions (Kabat numbering)

when appropriate. Examples of BEAT antibodies targeting both human CD38 antigen and human CD3 epsilon were formatted as follows:

A first example of BEAT antibodies targeting both human CD38 antigen and human CD3 epsilon using the humanized HB7 bestfit VH and VL sequences was formatted as follows: A BEAT CD38/CD3 antibody was engineered using a combination of antigen binding sites described in Example 2.1 and 2.3 for the anti-human CD3 epsilon and the anti-human CD38 arms, respectively. The anti-human CD38 arm of the hetero-dimeric immunoglobulin consisted of a BEAT heavy chain (SEQ ID NO: 169) encompassing a variable heavy chain region, a CH1 γ1 region, a γ1 hinge region, a γ1 CH2 region with L234A and L235A substitutions (EU numbering), and a γ1 based BEAT CH3 domain assembled with its cognate light chain (SEQ ID NO: 119). The anti-human CD3 epsilon arm of the hetero-dimeric immunoglobulin consisted of a BEAT heavy chain (SEQ ID NO: 162) encompassing a scFv fragment, a CH1 γ1 region, a γ1 hinge region, a γ3 CH2 region with L234A and L235A substitutions (EU numbering), and a γ3 based BEAT CH3 domain. This heavy chain encompassed part of a human IgG3 Fc region and therefore had no binding to Protein A but since the heavy chain used herein had its heavy chain variable domain originating from a VH3 framework, the VH domain was mutated to include the N82aS substitution thereby removing any additional Protein A binding sites within the heavy chain. This arm is equivalent to the BEAT HER2/CD3-2 anti-CD3 epsilon arm described above (see FIG. 12A format B). The bispecific antibody is referred herein as BEAT CD38-HB7bestfit/CD3 antibody (FIG. 19 format A).

Figure 20A:
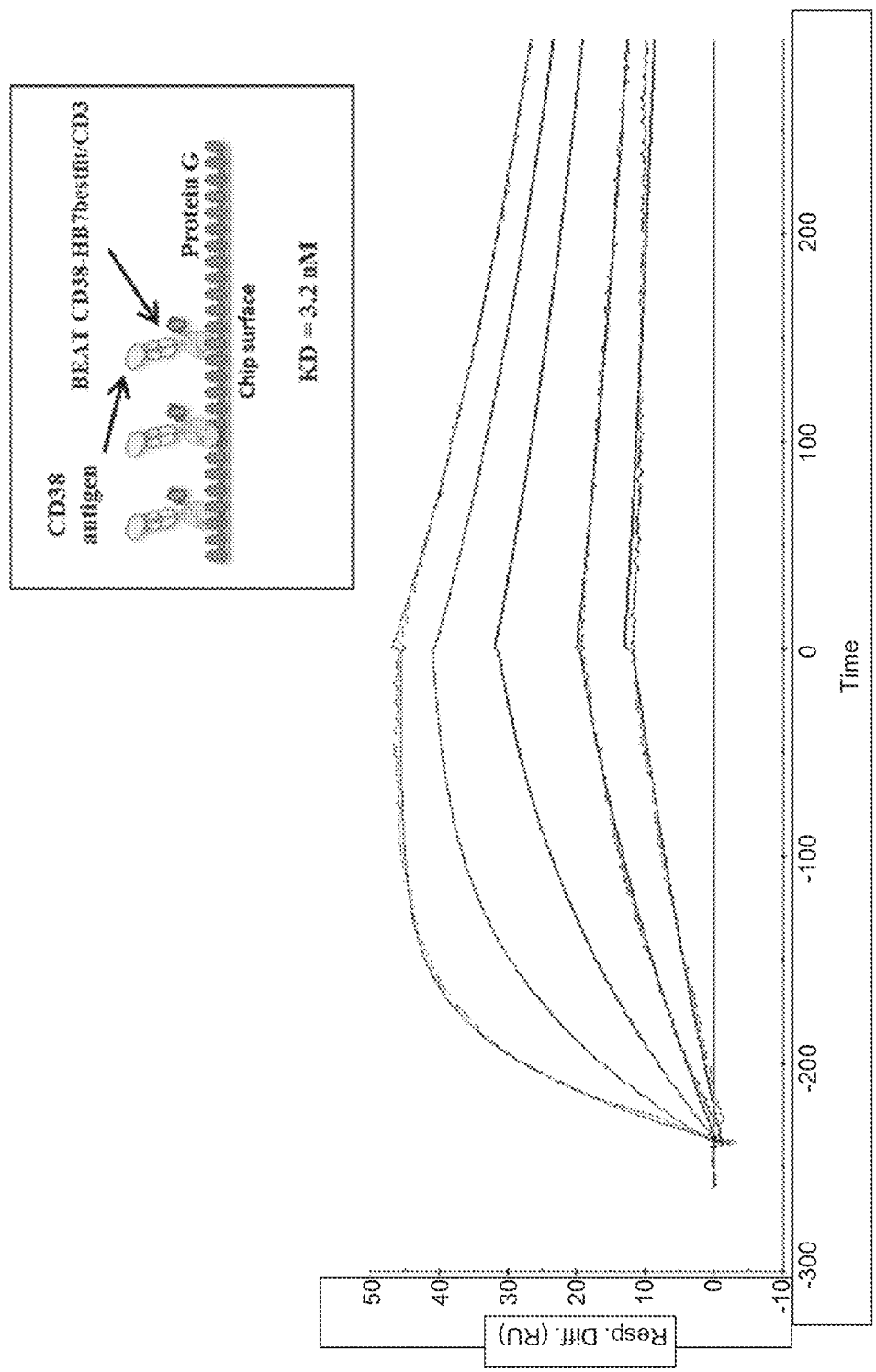
FIG. 20A: Antibody-antigen interaction measured by SPR between the BEAT CD38-HB7bestfit/CD3 antibody and the human CD38 antigen. A CM5 sensor chip was covalently coupled with protein G and 200 RUs of BEAT CD38-HB7bestfit/CD3 antibody were captured. Human CD38 protein (poly-histidine tagged protein) was injected at 50, 25, 12.5, 6.25 and 0.39 nM at a flow rate of 30 μl/min in HBS-P. Data are expressed as number of response units (abbreviated RU; Y axis) vs. time (X axis).

The BEAT CD38-HB7bestfit/CD3 antibody was expressed transiently, purified and tested in vitro for its affinity towards the CD38 and CD3 epsilon antigens, its stability and its ability to redirect T cell killing. The KD value was 3.2 nM for the human CD38 antigen (measured by SPR; FIG. 20A). DSC profiles for the bispecific antibody showed good thermo-stability profiles with a Tm of approximately 68° C. for the scFv portion. The FAB portion had a Tm of approximately 91° C. (FIG. 20B).

Figure 21:
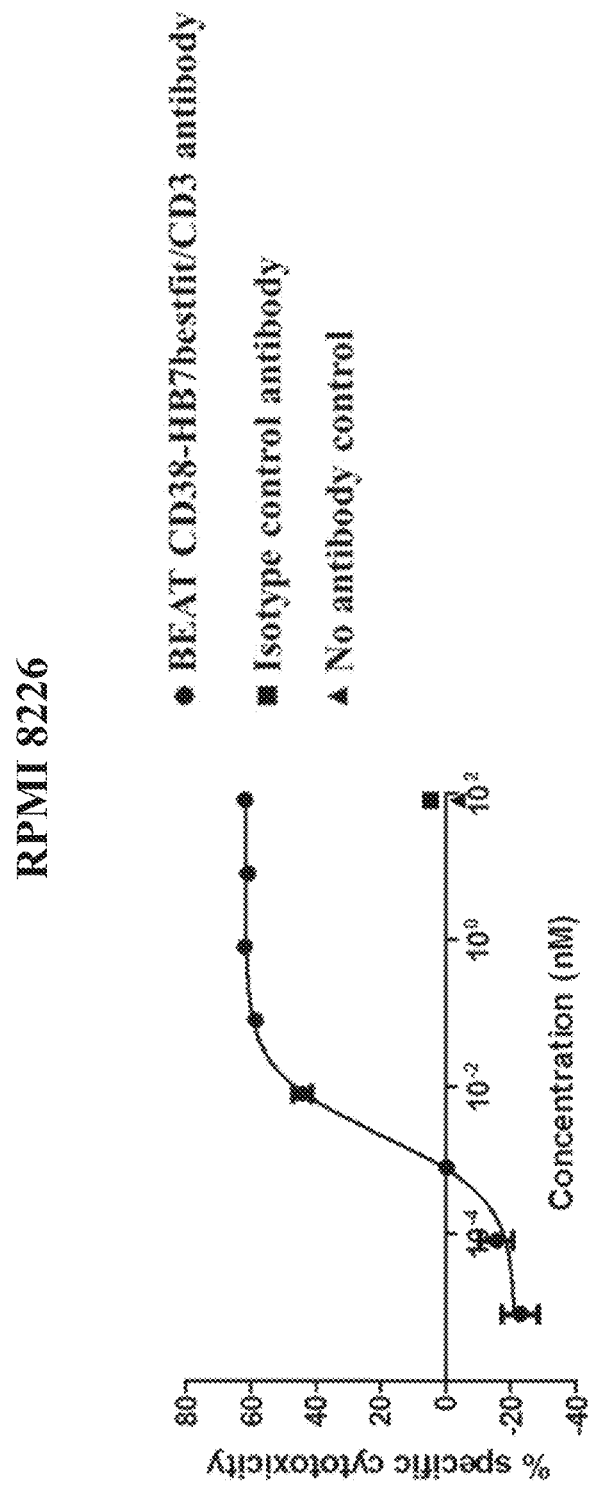
FIG. 21: Example of T cell redirected killing by the BEAT CD38-HB7bestfit/CD3 antibody. Readout: RDL-FACS method. Effector cells: purified human T cells. Effector cells-to-targeted cells ratio of 10:1. Mean of two donors with 48 h incubation. Target cells: RPMI 8226. Antibody concentration is shown in nM.

CD38 expressing cell lines (see Materials and Methods section) were used to assess redirected T cell killing in assays similar to that of described in Example 3.2.1. FIG. 21 shows T cell redirected killing of RPMI 8226 myeloma cells using the BEAT CD38-HB7bestfit/CD3 antibody. Note that the assay used purified T cells as effector cells with an effector cells to target cells ratio of 10 to 1. When measured with the RDL-FACS method, the BEAT CD38-HB7bestfit/CD3 antibody had an $EC_{50}$ of 2.2 pM (mean of 2 donors, 48 h incubation).

A second example of BEAT antibodies targeting both human CD38 antigen and human CD3 epsilon using the human clone 767 VH and VL sequences was formatted as follows: a BEAT CD38/CD3 antibody was engineered using a combination of antigen binding sites described in Example 2.1 and 2.3 for the anti-human CD3 epsilon and the anti-human CD38 arms, respectively. The anti-human CD38 arm of the hetero-dimeric immunoglobulin consisted of a BEAT heavy chain (SEQ ID NO: 170) encompassing a variable heavy chain region, a CH1 γ1 region, a γ1 hinge region, a γ1 CH2 region with L234A and L235A substitutions (EU numbering), and a γ1 based BEAT CH3 domain assembled with its cognate light chain (SEQ ID NO: 138). The anti-human CD3 epsilon arm of the hetero-dimeric immunoglobulin consisted of a BEAT heavy chain (SEQ ID NO: 171) encompassing a scFv fragment, a CH1 γ1 region, a γ1 hinge region, a γ3 CH2 region with L234A and L235A substitutions (EU numbering), and a γ3 based BEAT CH3 domain. This heavy chain encompassed part of a human IgG3 Fc region and therefore had no binding to Protein A but since the heavy chain used herein had its heavy chain variable domain originating from a VH3 framework, the VH domain was mutated to include the G65S substitution thereby removing any additional Protein A binding sites within the heavy chain. This bispecific antibody is referred herein as BEAT CD38-767/CD3 antibody (FIG. 19 format B).

Figure 22:
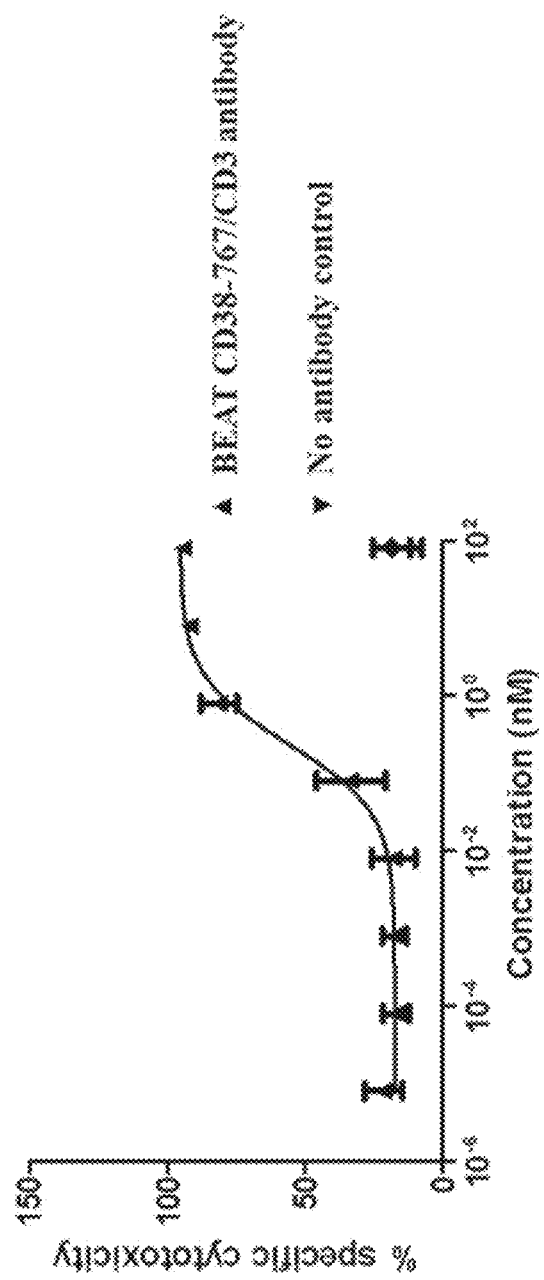
FIG. 22: Example of T cell redirected killing by the BEAT CD38-767/CD3(SP34) antibody. Readout: RDL-FACS method. Effector cells: human PBMC's. Effector cells-to-targeted cells ratio of 10:1. Mean of three donors with 24 h incubation. Target cells: Daudi. Antibody concentration is shown in nM.

The BEAT CD38-767/CD3 antibody was expressed transiently, purified and tested in vitro for its affinity towards the CD38 and CD3 epsilon antigens, its stability and its ability to redirect T cell killing. CD38 expressing cell lines (see Materials and Methods section) were used to assess redirected T cell killing in assays similar to that of described in Example 3.2.1. FIG. 22 shows T cell redirected killing of Daudi cells using the BEAT CD38-767/CD3 antibody. Note that the assay used human PBMCs as effector cells with an effector cells to target cells ratio of 10:1. When measured with the RDL-FACS method, the BEAT CD38-767/CD3 antibody had an $EC_{50}$ of 244 pM (mean of 3 donors, 24 h incubation).

Another example of BEAT antibodies targeting both human CD38 antigen and human CD3 epsilon using the humanized 9G7 best-framework VH and VL sequences is formatted as follows: a BEAT CD38/CD3 is engineered using a combination of antigen binding sites described in Example 2.1 and 2.3 for the anti-human CD3 epsilon and the anti-human CD38 antigen binding sites, respectively. The anti-human CD38 arm of the hetero-dimeric immunoglobulin consists of a BEAT heavy chain (SEQ ID NO: 312) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 132). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT CD38-9G7bestframework/CD3 (SP34-Kappa2) antibody.

Another example of BEAT antibodies targeting both human CD38 antigen and human CD3 epsilon using the human clone 767 VH and VL sequences is formatted as follows: a BEAT CD38/CD3 is engineered using a combination of antigen binding sites described in Example 2.1 and 2.3 for the anti-human CD3 epsilon and the anti-human CD38 antigen binding sites, respectively. The anti-human CD38 arm of the hetero-dimeric immunoglobulin consists of a BEAT heavy chain (SEQ ID NO: 313) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 138). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT CD38-767/CD3(SP34-Kappa2) antibody.

Examples of OX40/CD3 Targeting BEAT Antibodies

Figure 23:
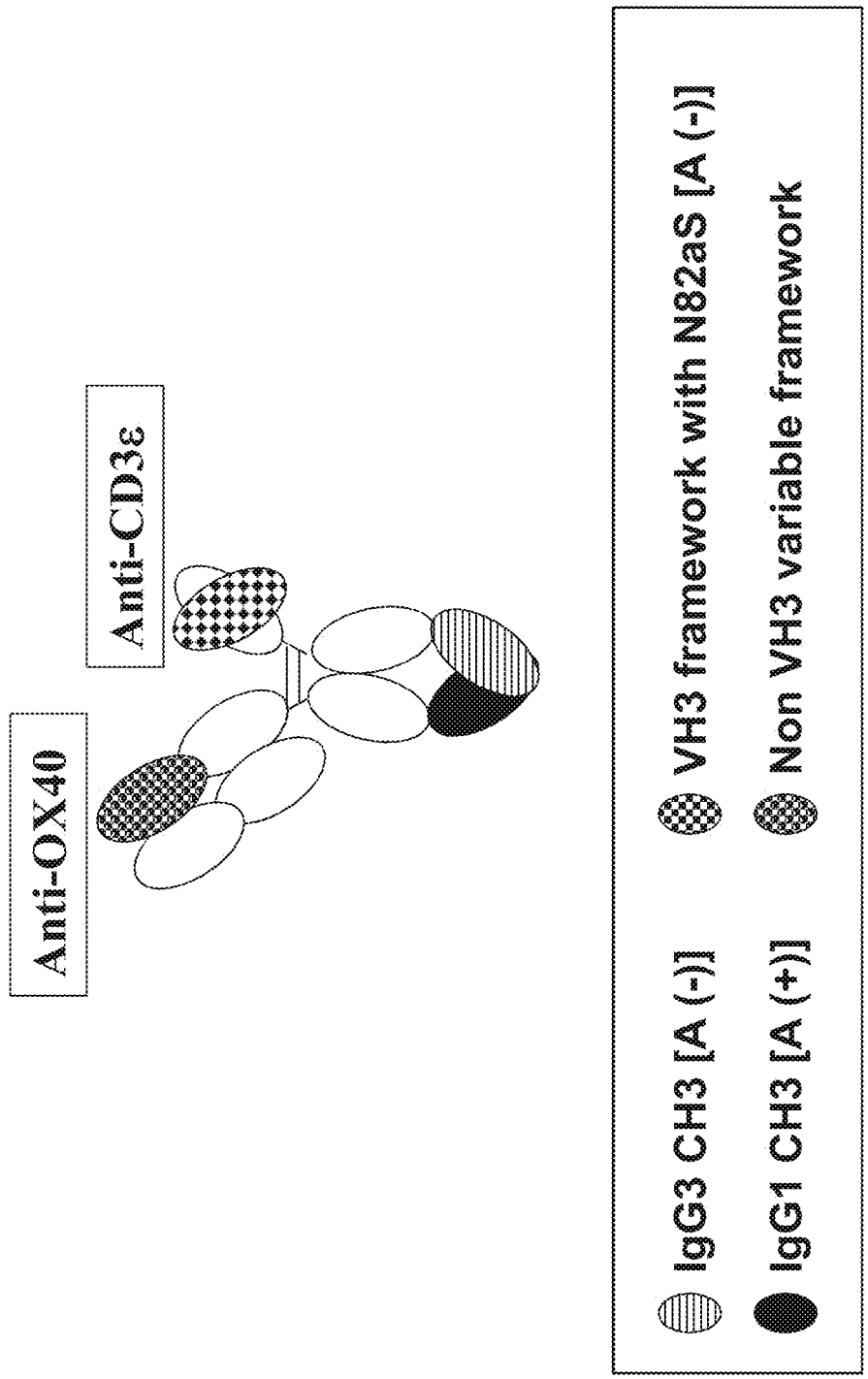
FIG. 23: Schematic diagram of the BEAT OX40/CD3antibody. Legend: [(A+)] means functional Protein A binding site. [(A−)] means nonfunctional Protein A binding site.

Anti-OX40 and anti-CD3 epsilon arms can be formatted either as a scFv-Fc type of heavy chains consisting of a scFv fragment fused to a BEAT chain or as a heavy chain consisting of a FAB fragment fused to a BEAT chain similar to that of a naturally occurring antibody. The FAB based heavy chain requires its association with its cognate light chain to assemble into a functional antigen binding site. L234A and L235A substitutions were introduced in CH2 regions and residual Protein A binding was abrogated within using the G65S or N82aS substitutions (Kabat numbering) when appropriate. Examples of BEAT antibodies targeting both human OX40 antigen and human CD3 epsilon were formatted as follows:

An example of BEAT OX40/CD3 antibody was engineered using a combination of antigen binding sites described in Example 2.1 and 2.4 for the anti-human CD3 epsilon and the anti-human OX40 arms, respectively. The anti-human OX40 arm of the hetero-dimeric immunoglobulin used the variable domains of the humanized anti-human OX40 antibody disclosed in PCT Publication No: WO2013008171 (variable heavy chain and light chain domains with SEQ ID NO: 141 and 142, respectively) and consisted of a BEAT heavy chain (SEQ ID NO: 172) encompassing a variable heavy chain region, a CH1 γ1 region, a γ1 hinge region, a γ1 CH2 region with L234A and L235A substitutions (EU numbering), and a γ1 based BEAT CH3 domain assembled with its cognate light chain (SEQ ID NO: 173). The anti-human CD3 epsilon arm of the hetero-dimeric immunoglobulin consisted of a BEAT heavy chain (SEQ ID NO: 162) encompassing a scFv fragment, a CH1 γ1 region, a γ1 hinge region, a γ3 CH2 region with L234A and L235A substitutions (EU numbering), and a γ3 based BEAT CH3 domain. This heavy chain encompassed part of a human IgG3 Fc region and therefore had no binding to Protein A but since the heavy chain used herein had its heavy chain variable domain originating from a VH3 framework, the VH domain was mutated to include the N82aS substitution thereby removing any additional Protein A binding sites within the heavy chain. This arm is equivalent to the BEAT HER2/CD3-2 anti-CD3 epsilon arm described above (see FIG. 12A format B). The bispecific antibody is referred herein as BEAT OX40/CD3 antibody (FIG. 23).

Figure 24:
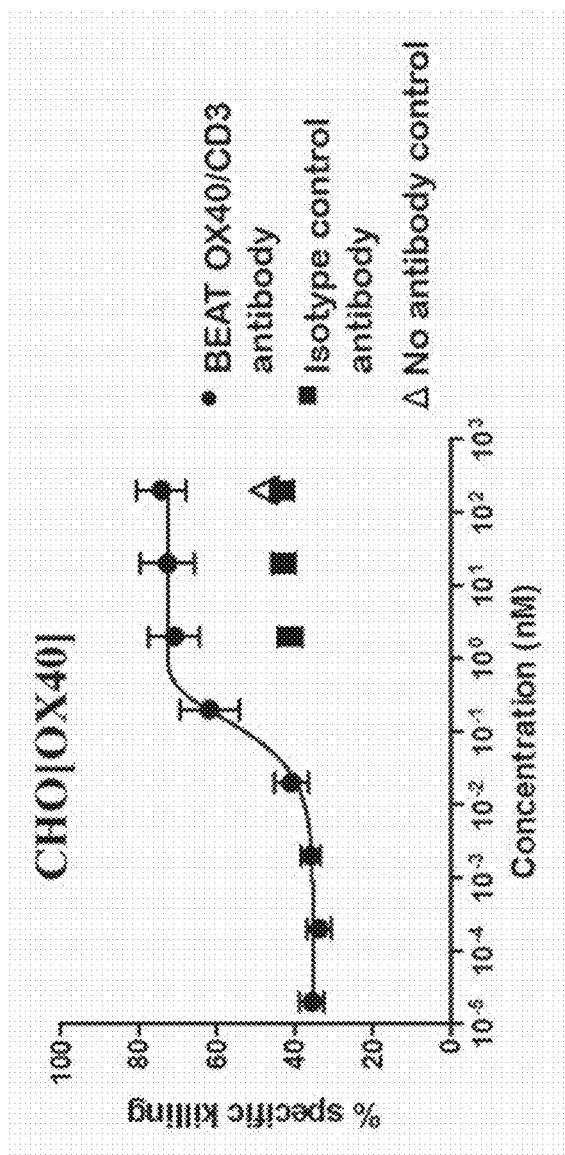
FIG. 24: Example of T cell redirected killing by the BEAT OX40/CD3antibody. Readout: RDL-MTS method. Effector cells: Human PBMCs. Effector cells-to-targeted cells ratio of 20:1. Mean of three donors with 48 h incubation. Target cells: recombinant stable CHO[OX40] cells. Antibody concentration is shown in nM.

The ability of the BEAT OX40/CD3 antibody to redirect T cell killing towards OX40+ cells was investigated in vitro. The stable recombinant CHO[OX40] cell line was used in killing assays. FIG. 24 show T cell redirected killing of stable recombinant CHO[OX40] cells by the BEAT OX40/CD3 antibody. The assays used human PBMCs as effector cells with an effector cells to target cells ratio of 20 to 1, and the RDL-MTS readout method after a 48 h incubation period (see Materials and Methods section). The results show that the BEAT OX40/CD3 antibody was highly potent at redirecting T cell killing against the stable recombinant CHO [OX40] cells with an $EC_{50}$ of 0.5 nM (mean of 3 donors).

Another example of BEAT antibodies targeting both human OX40 antigen and human CD3 epsilon using the humanized anti-OX40/maxgraft VH and VL sequences is formatted as follows: a BEAT OX40/CD3 is engineered using a combination of antigen binding sites described in Example 2.1 and 2.4 for the anti-human CD3 epsilon and the anti-human OX40 antigen binding sites, respectively. The anti-human OX40 arm of the hetero-dimeric immunoglobulin consists of a BEAT heavy chain (SEQ ID NO: 314) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 315). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT OX40maxgraft/CD3(SP34-Kappa2) antibody.

Another example of BEAT antibodies targeting both human OX40 antigen and human CD3 epsilon using the humanized anti-OX40/mingraft VH and VL sequences is formatted as follows: a BEAT OX40/CD3 is engineered using a combination of antigen binding sites described in Example 2.1 and 2.4 for the anti-human CD3 epsilon and the anti-human OX40 antigen binding sites, respectively. The anti-human OX40 arm of the hetero-dimeric immunoglobulin consists of a BEAT heavy chain (SEQ ID NO: 316) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 317). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT OX40mingraft/CD3(SP34-Kappa2) antibody.

Examples of CD20/CD3 Targeting BEAT Antibodies

An example of BEAT antibodies targeting both human CD20 antigen and human CD3 epsilon using the mouse rituximab antibody VH and VL sequences was formatted as follows: A BEAT CD20/CD3 was engineered using a combination of antigen binding sites described in Example 2.1 and 2.5 for the anti-human CD3 epsilon and the anti-human CD20 arms, respectively.

An example of BEAT antibodies targeting both human CD20 antigen and human CD3 epsilon using the humanized rituximab/maxgraft VH and VL sequences is formatted as follows: a BEAT CD20/CD3 is engineered using a combination of antigen binding sites described in Example 2.1 and 2.5 for the anti-human CD3 epsilon and the anti-human CD20 antigen binding sites, respectively. The anti-human CD20 arm of the hetero-dimeric immunoglobulin consists of a BEAT heavy chain (SEQ ID NO: 318) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 319). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT CD20maxgraft/CD3(SP34-Kappa2) antibody.

Another example of BEAT antibodies targeting both human CD20 antigen and human CD3 epsilon using the humanized rituximab/mingraft VH and VL sequences is formatted as follows: a BEAT CD20/CD3 is engineered using a combination of antigen binding sites described in Example 2.1 and 2.5 for the anti-human CD3 epsilon and the anti-human CD20 antigen binding sites, respectively. The anti-human CD20 arm of the hetero-dimeric immunoglobulin consists of a BEAT heavy chain (SEQ ID NO: 320) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 321). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT CD20mingraft/CD3(SP34-Kappa2) antibody.

Examples of EGFR/CD3 Targeting BEAT Antibodies

Figure 25:
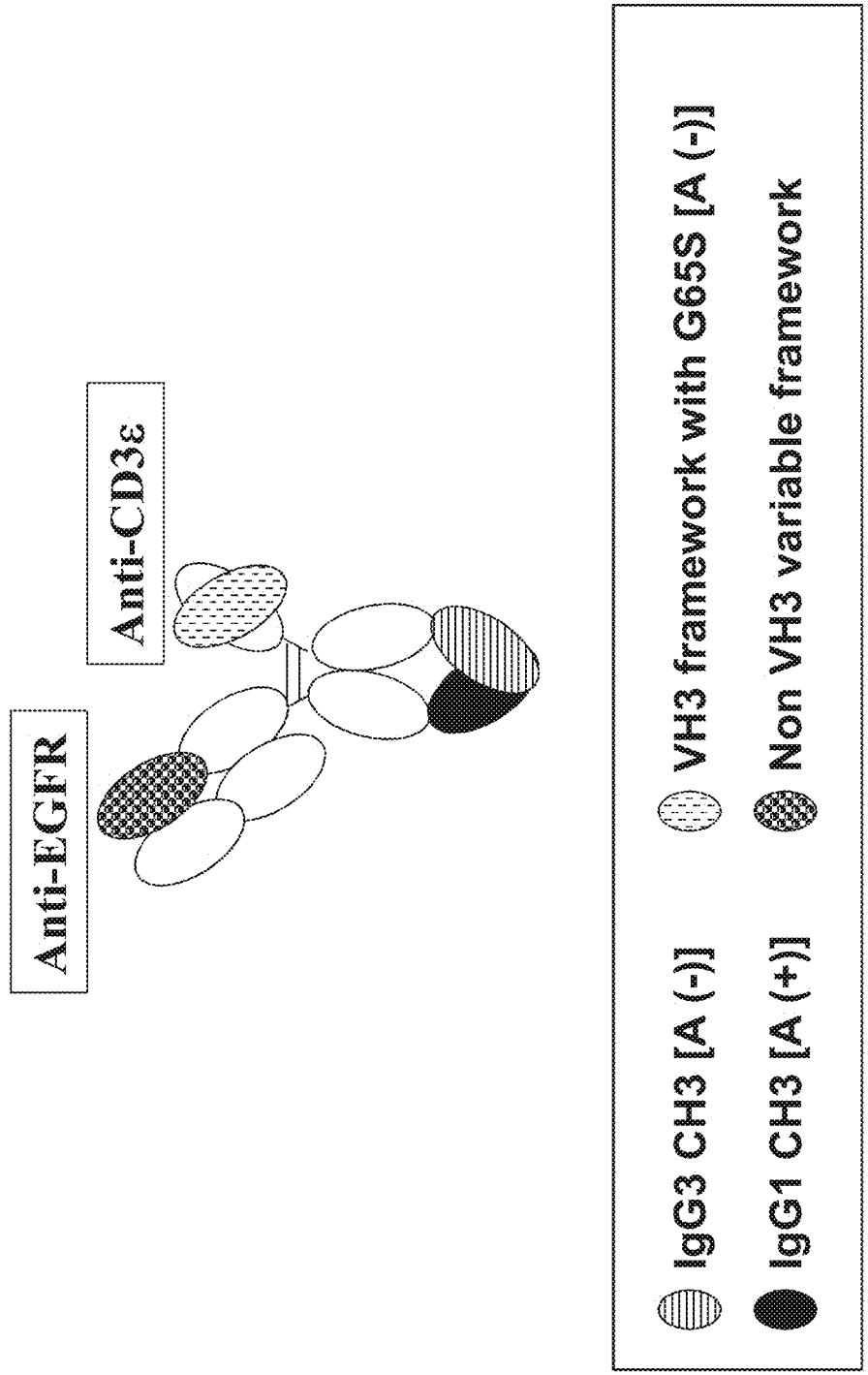
FIG. 25: Schematic diagram of the BEAT EGFR/CD3 antibody. Legend: [(A+)] means functional Protein A binding site. [(A−)] means nonfunctional Protein A binding site.

Anti-EGFR and anti-CD3 epsilon arms can be formatted either as a scFv-Fc type of heavy chains consisting of a scFv fragment fused to a BEAT chain or as a heavy chain consisting of a FAB fragment fused to a BEAT chain similar to that of a naturally occurring antibody. The FAB based heavy chain requires its association with its cognate light chain to assemble into a functional antigen binding site. L234A and L235A substitutions were introduced in CH2 regions and residual Protein A binding was abrogated within using the G65S or N82aS substitutions (Kabat numbering) when appropriate. Examples of BEAT antibodies targeting both human EGFR antigen and human CD3 epsilon were formatted as follows:

An example of BEAT antibodies targeting both human EGFR and human CD3 epsilon antigens is formatted as follows: a BEAT EGFR/CD3 is engineered using a combination of antigen binding sites described in Example 2.1 and 2.6 for the anti-human CD3 epsilon and the anti-human EGFR arms, respectively. The anti-human EGFR arm of the hetero-dimeric immunoglobulin consisted of a BEAT heavy chain (SEQ ID NO: 174) based on the mouse Erbitux antibody variable domains (mouse variable heavy and light chain domains with SEQ ID NO: 145 and 146, respectively) that encompassed a variable heavy chain region, a CH1 γ1 region, a γ1 hinge region, a γ1 CH2 region with L234A and L235A substitutions (EU numbering), and a γ1 based BEAT CH3 domain assembled with its cognate light chain (SEQ ID NO: 175). The anti-human CD3 epsilon arm of the hetero-dimeric immunoglobulin consisted of a BEAT heavy chain (SEQ ID NO: 171) encompassing a scFv fragment, a CH1 γ1 region, a γ1 hinge region, a γ3 CH2 region with L234A and L235A substitutions (EU numbering), and a γ3 based BEAT CH3 domain. This heavy chain encompassed part of a human IgG3 Fc region and therefore had no binding to Protein A but since the heavy chain used herein had its heavy chain variable domain originating from a VH3 framework, the VH domain was mutated to include the G65S substitution thereby removing any additional Protein A binding sites within the heavy chain. This arm is equivalent to the BEAT CD38-767/CD3 anti-CD3 epsilon arm described above (see FIG. 19 format B). The bispecific antibody is referred herein as BEAT EGFR/CD3 antibody (FIG. 25).

Figure 26:
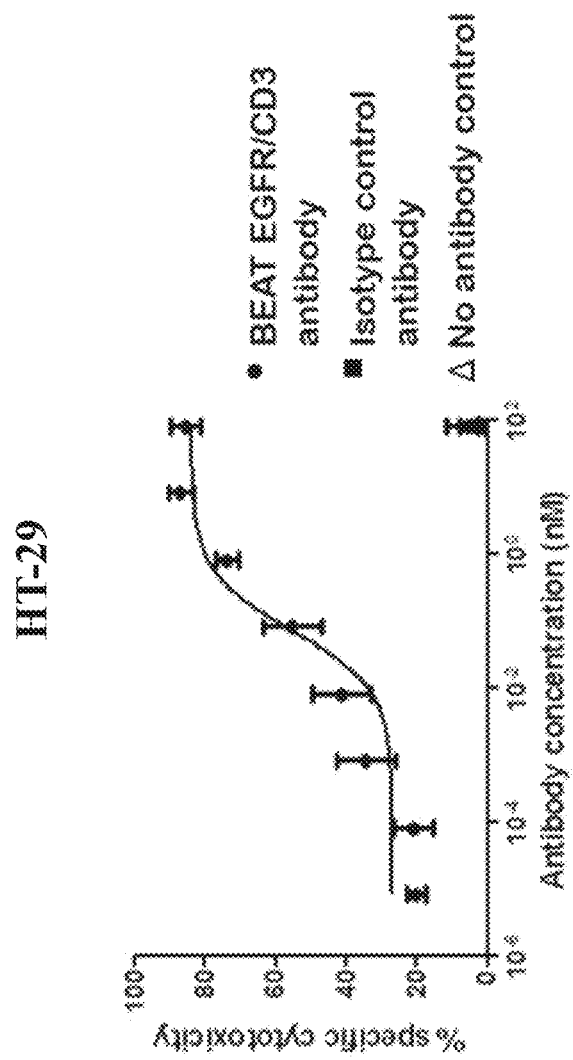
FIG. 26: Example of T cell redirected killing by the BEAT EGFR/CD3antibody. Readout: RDL-MTS method. Effector cells: Human PBMCs. Effector cells-to-targeted cells ratio of 10:1. Mean of four donors with 48 h incubation. Target cells: HT-29 cells. Antibody concentration is shown in nM.

The BEAT EGFR/CD3 antibody was transiently expressed, purified and tested in vitro for its ability to redirect T cell killing against human EGFR+ cell lines. The HT-29 cell line was used in killing assays. FIG. 26 show T cell redirected killing of HT-29 cells by the BEAT EGFR/CD3 antibody. The assays used human PBMCs as effector cells with an effector cells to target cells ratio of 10 to 1, and the RDL-MTS readout method after a 48 h incubation period (see Materials and Methods section). The results show that the BEAT EGFR/CD3 antibody was highly potent at redirecting T cell killing against HT-29 cells with an $EC_{50}$ of 70.6 pM (mean of 4 donors).

Another example of BEAT antibodies targeting both human EGFR antigen and human CD3 epsilon using the humanized Erbitux/maxgraft VH and VL sequences is formatted as follows: a BEAT EGFR/CD3 is engineered using a combination of antigen binding sites described in Example 2.1 and 2.6 for the anti-human CD3 epsilon and the anti-human EGFR antigen binding sites, respectively. The anti-human EGFR arm of the hetero-dimeric immunoglobulin consists of a BEAT heavy chain (SEQ ID NO: 322) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 323). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT EGFRcetux-maxgraft-CD3(SP34-Kappa2) antibody.

Another example of BEAT antibodies targeting both human EGFR antigen and human CD3 epsilon using the humanized Erbitux/mingraft VH and VL sequences is formatted as follows: a BEAT EGFR/CD3 is engineered using a combination of antigen binding sites described in Example 2.1 and 2.6 for the anti-human CD3 epsilon and the anti-human EGFR antigen binding sites, respectively. The anti-human EGFR arm of the hetero-dimeric immunoglobulin consists of a BEAT heavy chain (SEQ ID NO: 324) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 325). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon part of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT EGFRcetux-mingraft/CD3(SP34-Kappa2) antibody.

Another example of BEAT antibodies targeting both human EGFR antigen and human CD3 epsilon using the humanized Vectibix/maxgraft VH and VL sequences is formatted as follows: a BEAT EGFR/CD3 is engineered using a combination of antigen binding sites described in Example 2.1 and 2.6 for the anti-human CD3 epsilon and the anti-human EGFR antigen binding sites, respectively. The anti-human EGFR arm of the hetero-dimeric immunoglobulin consists of a BEAT heavy chain (SEQ ID NO: 326) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 327). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain.

The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT EGFRpani-maxgraft/CD3(SP34-Kappa2) antibody.

Another example of BEAT antibodies targeting both human EGFR antigen and human CD3 epsilon using the humanized Vectibix/mingraft VH and VL sequences is formatted as follows: a BEAT EGFR/CD3 is engineered using a combination of antigen binding sites described in Example 2.1 and 2.6 for the anti-human CD3 epsilon and the anti-human EGFR antigen binding sites, respectively. The anti-human EGFR arm of the hetero-dimeric immunoglobulin consists of a BEAT heavy chain (SEQ ID NO: 328) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 329). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT EGFRpani-mingraft/CD3(SP34-Kappa2) antibody.

Examples of CD19/CD3 BEAT Antibodies

Anti-CD19 and anti-CD3 heavy chains can be formatted either as a scFv-Fc type of heavy chains consisting of a scFv fragment fused to a first BEAT chain or as a heavy chain consisting of a FAB fragment fused to a first BEAT chain similar to that of a naturally occurring antibody. The FAB based heavy chain requires its association with its cognate light chain to assemble into a functional antigen binding site. L234A and L235A substitutions were introduced in CH2 regions and residual Protein A binding was abrogated within using the G65S or N82aS substitutions (Kabat numbering) when appropriate. An example of BEAT antibodies targeting both human CD19 antigen and human CD3 epsilon using anti-CD19 VH and VL sequences described in WO2010095031 is formatted as follows:

An example of BEAT CD19/CD3 is engineered using a combination of antigen binding sites described in Example 2.1 and 2.7 for the anti-human CD3 epsilon and the anti-human CD19 antigen binding sites, respectively. The anti-human CD19 arm of the hetero-dimeric immunoglobulin consists of a BEAT heavy chain (SEQ ID NO: 330) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 331). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT CD19/CD3(SP34-Kappa2) antibody.

CD19 expressing cell lines described in PCT Publication No: WO2010/095031 are used to assess redirected T cell killing in assays similar to that of described in Example 3.2.1.

Examples of IgE/CD3 BEAT Antibodies

Anti-IgE and anti-CD3 heavy chains can be formatted either as a scFv-Fc type of heavy chains consisting of a scFv fragment fused to a first BEAT chain or as a heavy chain consisting of a FAB fragment fused to a first BEAT chain similar to that of a naturally occurring antibody. The FAB based heavy chain requires its association with its cognate light chain to assemble into a functional antigen binding site. L234A and L235A substitutions were introduced in CH2 regions and residual Protein A binding was abrogated within using the G65S or N82aS substitutions (Kabat numbering) when appropriate. BEAT IgE/CD3 antibodies are engineered using a combination of antigen binding sites described in Example 2.1 and 2.8 for the anti-human CD3 epsilon and the anti-human IgE antigen binding sites, respectively. Cell lines expressing IgE on their cell surface are described in PCT Publication No: WO2010/033736 and can used to assess redirected T cell killing in assays similar to that of described in Example 3.2.1.

An example of BEAT antibodies targeting both human IgE antigen and human CD3 epsilon using the stabilized omalizumab/maxgraft VH and VL sequences is formatted as follows: The anti-human IgE arm of the hetero-dimeric immunoglobulin consists of a BEAT heavy chain (SEQ ID NO: 332) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 333). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT IgEomali-maxgraft/CD3(SP34-Kappa2) antibody.

Another example of BEAT antibodies targeting both human IgE antigen and human CD3 epsilon using the stabilized omalizumab/mingraft VH and VL sequences is formatted as follows: The anti-human IgE arm of the hetero-dimeric immunoglobulin consists of a BEAT heavy chain (SEQ ID NO: 334) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 335). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT IgEomali-mingraft/CD3(SP34-Kappa2)antibody.

Another example of BEAT antibodies targeting both human IgE antigen and human CD3 epsilon using the stabilized Bsw17/maxgraft VH and VL sequences is formatted as follows: The anti-human IgE arm of the hetero-dimeric immunoglobulin consists of a BEAT heavy chain (SEQ ID NO: 336) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 337). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT IgEbsw17-maxgraft/CD3(SP34-Kappa2) antibody.

Another example of BEAT antibodies targeting both human IgE antigen and human CD3 epsilon using the stabilized Bsw17/mingraft VH and VL sequences is formatted as follows: The anti-human IgE arm of the hetero-dimeric immunoglobulin consists of a BEAT heavy chain (SEQ ID NO: 338) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 339). This heavy chain encompasses part of a human IgG3 Fc region and therefore has no binding to Protein A but since the heavy chain used herein has its heavy chain variable domain originating from a VH3 framework, the VH domain is mutated to include the G65S substitution thereby removing any additional Protein A binding sites within the heavy chain. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT IgE bsw17-mingraft/CD3(SP34-Kappa2) antibody.

Examples of BEAT Antibodies Encompassing Only One VH3 Domain

Examples of CD38/CD3 Targeting BEAT Antibodies

Figure 27:
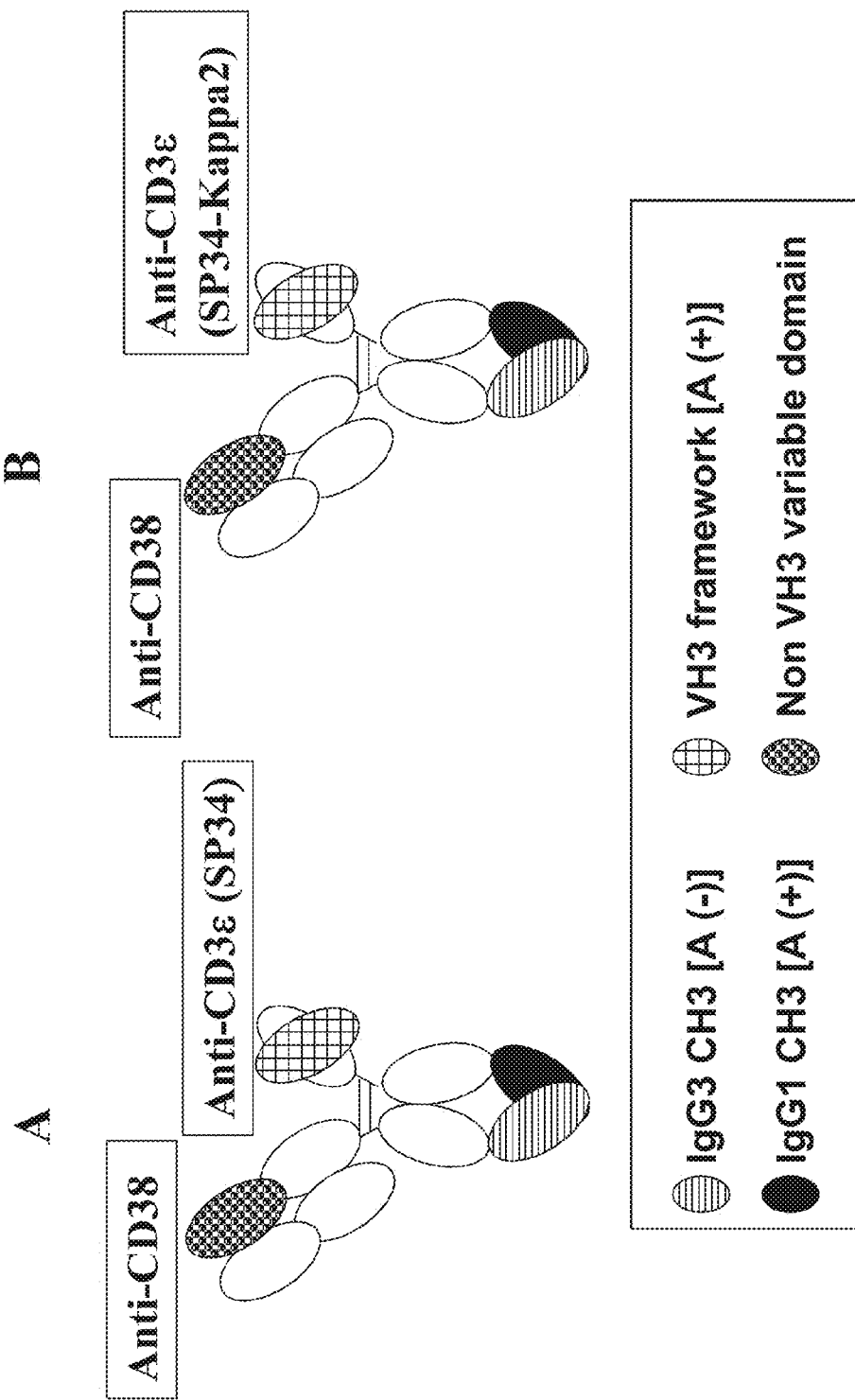
FIG. 27: Schematic diagram of the BEAT CD38-HB7bestfit/CD3(SP34) (format A) and BEAT CD38-9G7bestfit/CD3(SP34-Kappa2) (format B) antibodies. [(A+)] means functional Protein A binding site.

An example of BEAT antibodies targeting both human CD38 antigen and human CD3 epsilon using the humanized HB7/bestfit VH and VL sequences was formatted as follows: a BEAT CD38/CD3 was engineered using a combination of antigen binding sites described in Example 2.1 and 2.3 for the anti-human CD3 epsilon and the anti-human CD38 arms, respectively. The anti-human CD38 arm of the hetero-dimeric immunoglobulin consisted of a BEAT heavy chain (SEQ ID NO: 176) encompassing a variable heavy chain domain, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 119). This heavy chain had no binding to Protein A as it encompassed part of a human IgG3 Fc region and had its heavy chain variable domain originating from a non-VH3 domain subclass. The anti-human CD3 epsilon arm of the hetero-dimeric immunoglobulin consisted of a BEAT heavy chain (SEQ ID NO: 177) encompassing a scFv fragment, a CH1 γ1 region, a γ1 hinge region, a γ1 CH2 region with L234A and L235A substitutions (EU numbering), and a γ1 based BEAT CH3 domain. This heavy chain and light assembly encompassed a humanized version of the anti-human CD3 epsilon antibody (SP34) as described in PCT Publication No: WO2008119565. This BEAT antibody format is referred herein as BEAT CD38-HB7bestfit/CD3 (SP34) antibody (FIG. 27 format A).

Figure 28:
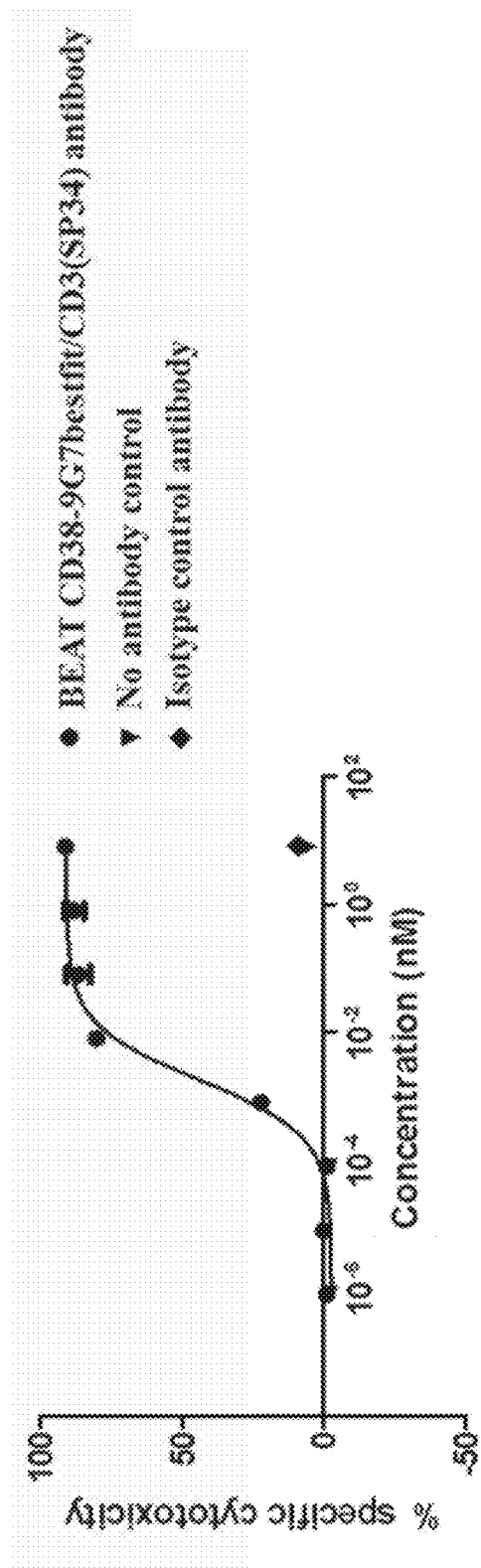
FIG. 28: Example of T cell redirected killing by the BEAT CD38-HB7bestfit/CD3(SP34) antibody. Readout: RDL-FACS method. Effector cells: Human PBMCs. Effector cells-to-targeted cells ratio of 10:1. Mean of three donors with 24 h incubation. Target cells: Daudi cells. Antibody concentration is shown in nM.

The ability of the BEAT CD38-HB7bestfit/CD3(SP34) antibody to redirect T cell killing towards CD38+ cells was investigated in-vitro. The CD38+ B lymphoblast cell line Daudi was used in killing assays. FIG. 28 show T cell redirected killing of Daudi cells by the BEAT CD38-HB7bestfit/CD3(SP34) antibody. The assays used human PBMCs as effector cells with an effector cells to target cells ratio of 10 to 1, and the RDL-FACS readout method after a 24 h incubation period (see Materials and Methods section). The results show that the BEAT CD38-HB7bestfit/CD3 (SP34) antibody was highly potent at redirecting T cell killing against the Daudi CD38+ cell line with an $EC_{50}$ of 1.8 pM (mean of 3 donors).

Figure 29:
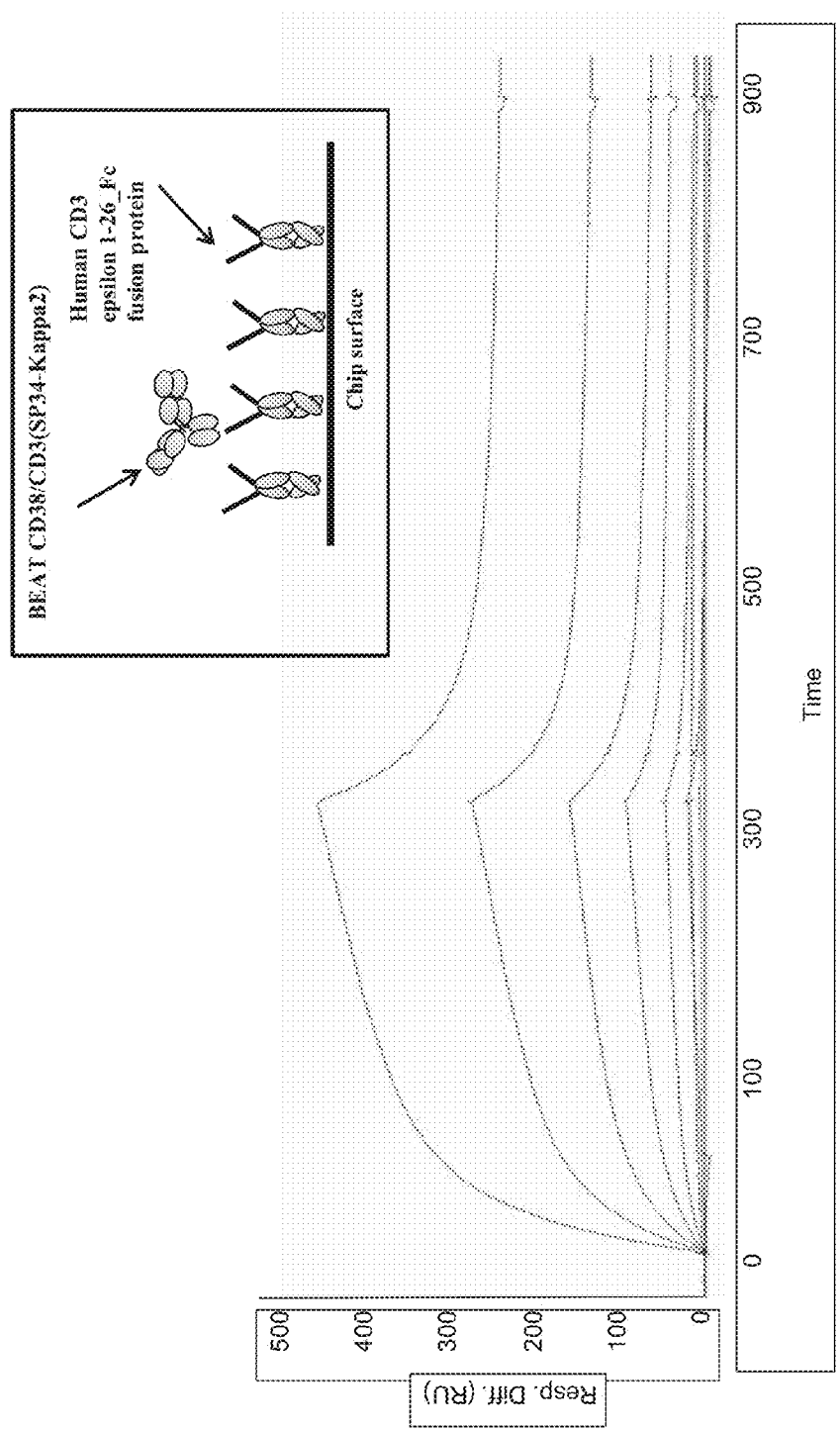
FIG. 29: Antibody-antigen interaction measured by SPR between the BEAT CD38-9G7bestfit/CD3(SP34-Kappa2) antibody and the human CD3 epsilon 1-26_Fc fusion protein. A CM5 sensor chip was covalently coupled with 500 RUs of the human CD3 epsilon 1-26_Fc fusion protein. BEAT CD38-9G7bestfit/CD3(SP34-Kappa2) antibody was injected at 50, 25, 12.5, 6.2, 3.1, 0.8 and 0.4 nM at a flow rate of 30 μl/min in HBS-P. Data are expressed as number of response units (abbreviated RU; Y axis) vs. time (X axis).

A second example of BEAT antibodies targeting both human CD38 antigen and human CD3 epsilon using the humanized 9G7 best-fit VH and VL sequences (SEQ ID NO: 129 and 130, respectively) was formatted as follows: a BEAT CD38/CD3 was engineered using a combination of antigen binding sites described in Example 2.1 and 2.3 for the anti-human CD3 epsilon and the anti-human CD38 arms, respectively. The anti-human CD38 arm of the hetero-dimeric immunoglobulin consisted of a BEAT heavy chain (SEQ ID NO: 178) encompassing a variable heavy chain domain, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 128). This heavy chain had no binding to Protein A as it encompassed part of a human IgG3 Fc region and had its heavy chain variable domain originating from a non-VH3 domain subclass. The anti-human CD3 epsilon arm of the hetero-dimeric immunoglobulin consisted of a BEAT heavy chain (SEQ ID NO: 179) encompassing a scFv fragment, a CH1 γ1 region, a γ1 hinge region, a γ1 CH2 region with L234A and L235A substitutions (EU numbering), and a γ1 based BEAT CH3 domain. This arm of the bispecific antibody encompassed the variable domains of the humanized SP34 VH5/VL32 antibody described in Example 2.1. This BEAT antibody format is referred herein as BEAT CD38-9G7best-fit/CD3(SP34-Kappa2) antibody (FIG. 27 format B). CD38-9G7best-fit/CD3(SP34-Kappa2) antibody had a KD value of 18 nM for the human CD3 1-26_Fc fusion protein (FIG. 29).

Figure 30:
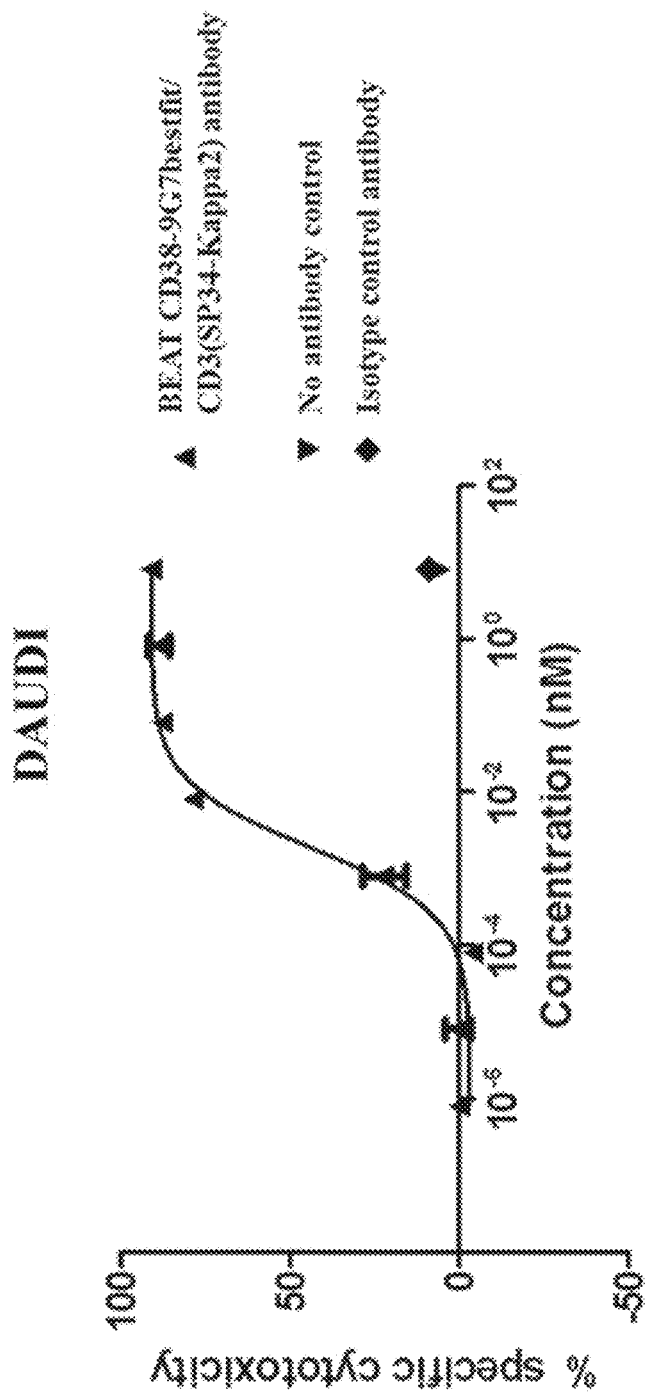
FIG. 30: Example of T cell redirected killing by the BEAT CD38/CD3(SP34-Kappa2) antibody. Readout: RDL-FACS method. Effector cells: Human PBMCs. Effector cells-to-targeted cells ratio of 10:1. Mean of three donors with 24 h incubation. Target cells: Daudi cells. Antibody concentration is shown in nM.

The ability of the BEAT CD38-9G7best-fit/CD3(SP34-Kappa2) antibody to redirect T cell killing towards CD38+ cells was investigated in vitro. The CD38+ B lymphoblast cell line Daudi was used in killing assays. FIG. 30 show T cell redirected killing of Daudi cells by the BEAT CD38-9G7best-fit/CD3(SP34-Kappa2) antibody. The assays used human PBMCs as effector cells with an effector cells to target cells ratio of 10 to 1, and the RDL-FACS readout method after a 24 h incubation period (see Materials and Methods section). The results show that the BEAT CD38-9G7best-fit/CD3(SP34-Kappa2) antibody was highly potent at redirecting T cell killing against the Daudi CD38+ cell line with an $EC_{50}$ of 2 pM (mean of 3 donors).

Examples of OX40/CD3 Targeting BEAT Antibodies

An example of BEAT antibodies targeting both human OX40 antigen and human CD3 epsilon using the humanized anti-OX40 antibody VH and VL sequences (PCT Publication No: WO2013008171) is formatted as follows: A BEAT OX40/CD3 is engineered using a combination of antigen binding sites described in Example 2.1 and 2.4 for the anti-human CD3 epsilon and the anti-human OX40 antigen binding sites, respectively. The anti-human OX40 arm of the hetero-dimeric immunoglobulin consists of a BEAT heavy chain (SEQ ID NO: 340) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 173). This heavy chain has no binding to Protein A as it encompasses part of a human IgG3 Fc region and has its heavy chain variable domain originating from a non-VH3 domain subclass. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain.

This bispecific antibody is referred herein as BEAT OX40/CD3(SP34-Kappa2) antibody.

Human OX40 expressing cell lines described above are used to assess redirected T cell killing in assays similar to that of described in Example 3.2.4.

Examples of CD20/CD3 Targeting BEAT Antibodies

An example of BEAT antibodies targeting both human CD20 antigen and human CD3 epsilon using the mouse rituximab antibody VH and VL sequences was formatted as follows: A BEAT CD20/CD3 was engineered using a combination of antigen binding sites described in Example 2.1 and 2.5 for the anti-human CD3 epsilon and the anti-human CD20 arms, respectively.

Figure 31:
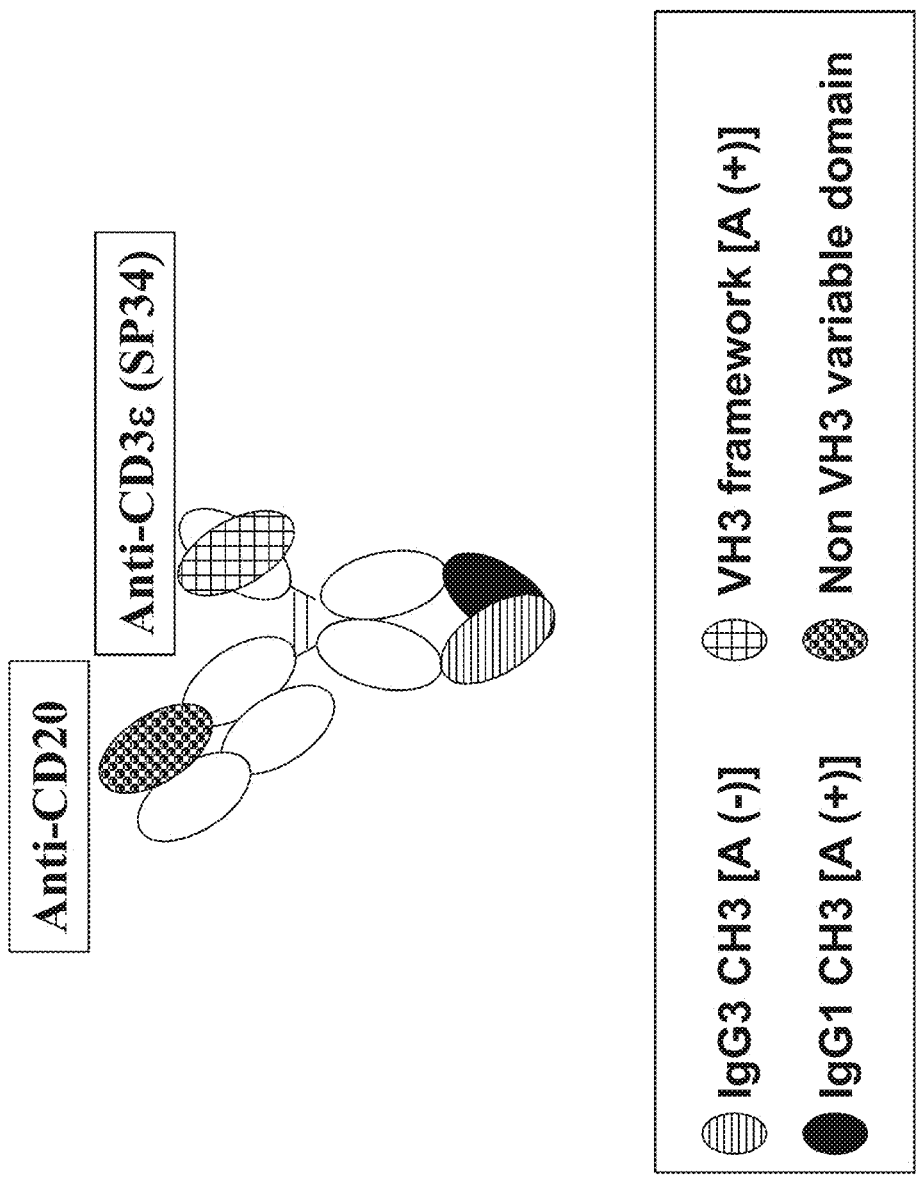
FIG. 31: Schematic diagram of the BEAT CD20/CD3(SP34) antibody. [(A+)] means functional Protein A binding site.

The anti-human CD20 arm of the hetero-dimeric immunoglobulin consisted of a BEAT heavy chain (SEQ ID NO: 180) based on the mouse rituximab antibody variable domains (mouse variable heavy and light chain domains with SEQ ID NO: 143 and 144, respectively) that encompassed a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 181). This heavy chain had no binding to Protein A as it encompassed part of a human IgG3 Fc region and had its heavy chain variable domain originating from a non-VH3 domain subclass. The anti-human CD3 epsilon arm of the hetero-dimeric immunoglobulin consisted of a BEAT heavy chain (SEQ ID NO: 177) encompassing a scFv fragment, a CH1 γ1 region, a γ1 hinge region, a γ1 CH2 region with L234A and L235A substitutions (EU numbering), and a γ1 based BEAT CH3 domain. This arm is equivalent to the BEAT CD38-HB7bestfit/CD3 anti-CD3 epsilon arm described above (see FIG. 27 format A). This scFv fragment encompassed a humanized version of the anti-human CD3 epsilon SP34 antibody as described in PCT Publication No: WO2008119565 (VH and VL domains with SEQ ID NO: 182 and 183, respectively). This BEAT antibody format is referred herein as BEAT CD20/CD3(SP34) antibody (FIG. 31).

Figure 32:
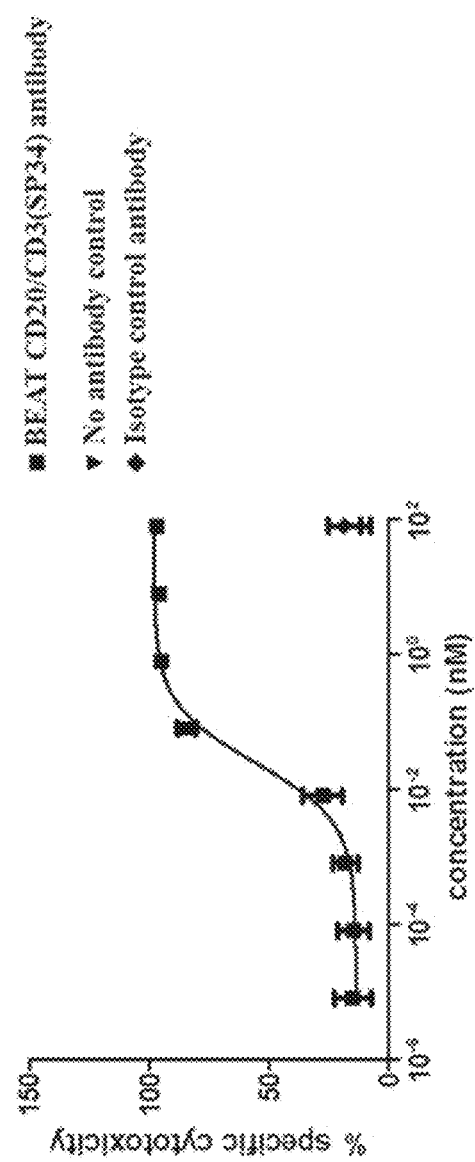
FIG. 32: Example of T cell redirected killing by the BEAT CD20/CD3(SP34) antibody. Readout: RDL-FACS method. Effector cells: Human PBMCs. Effector cells-to-targeted cells ratio of 10:1. Means of three donors with 24 h incubation. Target cells: Daudi cells. Antibody concentration is shown in nM.

The BEAT CD20/CD3(SP34) antibody was transiently expressed, purified and tested in vitro for its ability to redirect T cell killing against human CD20+ cell lines. The CD38+ B lymphoblast cell line Daudi was used in killing assays. FIG. 32 show T cell redirected killing of Daudi cells by the BEAT CD20/CD3(SP34) antibody. The assays used human PBMCs as effector cells with an effector cells to target cells ratio of 10 to 1, and the RDL-FACS readout method after a 24 h incubation period (see Materials and Methods section). The results show that the BEAT CD20/CD3(SP34) antibody was highly potent at redirecting T cell killing against Daudi cells with an $EC_{50}$ of 25 pM (mean of 3 donors).

Another example of BEAT antibodies targeting both human CD20 antigen and human CD3 epsilon using the chimeric rituximab antibody VH and VL sequences is formatted as follows: a BEAT EGFR/CD3 is engineered using a combination of antigen binding sites described in Example 2.1 and 2.5 for the anti-human CD3 epsilon and the anti-human CD20 antigen binding sites, respectively.

The anti-human CD20 arm of the hetero-dimeric immunoglobulin consists of a BEAT heavy chain (SEQ ID NO: 341) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 181). This heavy chain has no binding to Protein A as it encompasses part of a human IgG3 Fc region and has its heavy chain variable domain originating from a non-VH3 domain subclass.

The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT CD20/CD3(SP34-Kappa2) antibody.

Examples of EGFR/CD3 Targeting BEAT Antibodies

An example of BEAT antibodies targeting both human EGFR antigen and human CD3 epsilon using the mouse Erbitux antibody VH and VL sequences is formatted as follows: a BEAT EGFR/CD3 is engineered using a combination of antigen binding sites described in Example 2.1 and 2.6 for the anti-human CD3 epsilon and the anti-human EGFR antigen binding sites, respectively. The anti-human EGFR arm of the hetero-dimeric immunoglobulin consists of a BEAT heavy chain (SEQ ID NO: 342) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 175). This heavy chain has no binding to Protein A as it encompasses part of a human IgG3 Fc region and has its heavy chain variable domain originating from a non-VH3 domain subclass.

The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT EGFRcetux/CD3(SP34-Kappa2) antibody.

Another example of BEAT antibodies targeting both human EGFR antigen and human CD3 epsilon using the human Vectibix antibody VH and VL sequences is formatted as follows: a BEAT EGFR/CD3 is engineered using a combination of antigen binding sites described in Example 2.1 and 2.6 for the anti-human CD3 epsilon and the anti-human EGFR antigen binding sites, respectively. The anti-human EGFR arm of the hetero-dimeric immunoglobulin consists of a BEAT heavy chain (SEQ ID NO: 343) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 344). This heavy chain has no binding to Protein A as it encompasses part of a human IgG3 Fc region and has its heavy chain variable domain originating from a non-VH3 domain subclass. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT EGFRpani/CD3(SP34-Kappa2) antibody.

Examples of IgE/CD3 Targeting BEAT Antibodies

An example of BEAT antibodies targeting both human IgE antigen and human CD3 epsilon using the humanized omalizumab antibody VH and VL sequences is formatted as follows: a BEAT IgE/CD3 is engineered using a combination of antigen binding sites described in Example 2.1 and 2.8 for the anti-human CD3 epsilon and the anti-human IgE antigen binding sites, respectively. The anti-human IgE arm of the hetero-dimeric immunoglobulin consists of a BEAT heavy chain (SEQ ID NO: 345) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 346). This heavy chain has no binding to Protein A as it encompasses part of a human IgG3 Fc region and has its heavy chain variable domain originating from a non-VH3 domain subclass. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT IgEomali/CD3(SP34-Kappa2) antibody.

Another example of BEAT antibodies targeting both human IgE antigen and human CD3 epsilon using the mouse Bsw17 antibody VH and VL sequences is formatted as follows: a BEAT IgE/CD3 is engineered using a combination of antigen binding sites described in Example 2.1 and 2.8 for the anti-human CD3 epsilon and the anti-human IgE antigen binding sites, respectively. The anti-human IgE arm of the hetero-dimeric immunoglobulin consists of a BEAT heavy chain (SEQ ID NO: 347) encompassing a variable heavy chain region, a CH1 γ1 region, a γ1 hinge region, a γ3 CH2 region with L234A and L235A substitutions (EU numbering), and a γ3 based BEAT CH3 domain assembled with its cognate light chain (SEQ ID NO: 348). This heavy chain has no binding to Protein A as it encompasses part of a human IgG3 Fc region and has its heavy chain variable domain originating from a non-VH3 domain subclass. The anti-human CD3 epsilon arm of the hetero-dimeric immunoglobulin consists of a BEAT heavy chain (SEQ ID NO: 311) encompassing a scFv fragment, a CH1 γ1 region, a γ1 hinge region, a γ1 CH2 region with L234A and L235A substitutions (EU numbering), and a γ1 based BEAT CH3 domain. This bispecific antibody is referred herein as BEAT IgEbsw17/CD3(SP34-Kappa2) antibody.

Membrane IgE expressing cell lines described are used to assess redirected T cell killing in assays similar to that of described above.

Sequence listing

| | | |
|---|---|---|
| SEQ ID NO: 1 - Fc 133 | | DKTHTCPPCPAPELLGGPSVFLFPPKPKDTLMISRTPEVTCVV<br>VDVSHEDPEVQFKWYVDGVEVHNAKTKPREEQYNSTFRVVS<br>VLTVLHQDWLNGKEYKCKVSNKALPAPIEKTISKTKGQPREP<br>QVYTLPPSREEMTKNQVSLTCLVKGFYPSDIAVEWESSGQPE<br>NNYNTTPPMLDSDGSFFLYSKLTVDKSRWQQGNIFSCSVMHE<br>ALHNRFTQKSLSLSPGK |
| SEQ ID NO: 2 - anti-HER2 FAB-Fc 133 heavy chain | | EVQLVESGGGLVQPGGSLRLSCAASGFNIKDTYIHWVRQAPG<br>KGLEWVARIYPTNGYTRYADSVKGRFTISADTSKNTAYLQM<br>NSLRAEDTAVYYCSRWGGDGFYAMDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSCDKTHTCPPCPAPELLGGPSVFLFPPKPK |

| | |
|---|---|
| | DTLMISRTPEVTCVVVDVSHEDPEVQFKWYVDGVEVHNAKT<br>KPREEQYNSTFRVVSVLTVLHQDWLNGKEYKCKVSNKALPA<br>PIEKTISKTKGQPREPQVYTLPPSREEMTKNQVSLTCLVKGFY<br>PSDIAVEWESSGQPENNYNTTPPMLDSDGSFFLYSKLTVDKSR<br>WQQGNIFSCSVMHEALHNRFTQKSLSLSPGK |
| SEQ ID NO: 3 - anti-<br>HER2 light chain | DIQMTQSPSSLSASVGDRVTITCRASQDVNTAVAWYQQKPGK<br>APKLLIYSASFLYSGVPSRFSGSRSGTDFTLTISSLQPEDFATYY<br>CQQHYTTPPTFGQGTKVEIKRTVAAPSVFIFPPSDEQLKSGTAS<br>VVCLLNNFYPREAKVQWKVDNALQSGNSQESVTEQDSKDST<br>YSLSSTLTLSKADYEKHKVYACEVTHQGLSSPVTKSFNRGEC |
| SEQ ID NO: 4 - anti-<br>HER2 scFv-Fc 133 | EVQLVESGGGLVQPGGSLRLSCAASGFNIKDTYIHWVRQAPG<br>KGLEWVARIYPTNGYTRYADSVKGRFTISADTSKNTAYLQM<br>NSLRAEDTAVYYCSRWGGDGFYAMDYWGQGTLVTVSSGGG<br>GSGGGGSGSGGGSDIQMTQSPSSLSASVGDRVTITCRASQDVN<br>TAVAWYQQKPGKAPKLLIYSASFLYSTVPSRFSGSRSGTDFTL<br>TISSLQPEDFATYYCQQHYTTPPTFGQGTKVEIKRGGGGTDKT<br>HTCPPCPAPELLGGPSVFLFPPKPKDTLMISRTPEVTCVVVDVS<br>HEDPEVQFKWYVDGVEVHNAKTKPREEQYNSTFRVVSVLTV<br>LHQDWLNGKEYKCKVSNKALPAPIEKTISKTKGQPREPQVYT<br>LPPSREEMTKNQVSLTCLVKGFYPSDIAVEWESSGQPENNYN<br>TTPPMLDSDGSFFLYSKLTVDKSRWQQGNIFSCSVMHEALHN<br>RFTQKSLSLSPGK |
| SEQ ID NO: 5 - anti-<br>HER2 FAB heavy chain | EVQLVESGGGLVQPGGSLRLSCAASGFNIKDTYIHWVRQAPG<br>KGLEWVARIYPTNGYTRYADSVKGRFTISADTSKNTAYLQM<br>NSLRAEDTAVYYCSRWGGDGFYAMDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSC |
| SEQ ID NO: 6 - anti-<br>HER2 FAB G65S heavy<br>chain | EVQLVESGGGLVQPGGSLRLSCAASGFNIKDTYIHWVRQAPG<br>KGLEWVARIYPTNGYTRYADSVKSRFTISADTSKNTAYLQMN<br>SLRAEDTAVYYCSRWGGDGFYAMDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPS<br>NTKVDKKVEPKSC |
| SEQ ID NO: 7 - anti-<br>HER2 FAR R66Q heavy<br>chain | EVQLVESGGGLVQPGGSLRLSCAASGFNIKDTYIHWVRQAPG<br>KGLEWVARIYPTNGYTRYADSVKGQFTISADTSKNTAYLQM<br>NSLRAEDTAVYYCSRWGGDGFYAMDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSC |
| SEQ ID NO: 8 - anti-<br>HER2 FAB T68V heavy<br>chain | EVQLVESGGGLVQPGGSLRLSCAASGFNIKDTYIHWVRQAPG<br>KGLEWVARIYPTNGYTRYADSVKGRFVISADTSKNTAYLQM<br>NSLRAEDTAVYYCSRWGGDGFYAMDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSC |
| SEQ ID NO: 9 - anti-<br>HER2 FAB Q81E heavy<br>chain | EVQLVESGGGLVQPGGSLRLSCAASGFNIKDTYIHWVRQAPG<br>KGLEWVARIYPTNGYTRYADSVKGRIFTISADTSKNTAYLEM<br>NSLRAEDTAVYYCSRWGGDGFYAMDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSC |
| SEQ ID NO: 10 - anti-<br>HER2 FAB N82aS<br>heavy chain | EVQLVESGGGLVQPGGSLRLSCAASGFNIKDTYIHWVRQAPG<br>KGLEWVARIYPTNGYTRYADSVKGRFTISADTSKNTAYLQMS<br>SLRAEDTAVYYCSRWGGDGFYAMDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPS<br>NTKVDKKVEPKSC |
| SEQ ID NO: 11 - anti-<br>HER2 FAB<br>R19G/T57A/Y59A<br>heavy chain. | EVQLVESGGGLVQPGGSLGLSCAASGFNIKDTYIHWVRQAPG<br>KGLEWVARIYPTNGYARAADSVKGRFTISADTSKNTAYLQM<br>NSLRAEDTAVYYCSRWGGDGFYAMDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSC |

| Sequence listing | |
|---|---|
| SEQ ID NO: 12 - anti-HER2 FAB T57A heavy chain. | EVQLVESGGGLVQPGGSLRLSCAASGFNIKDTYIHWVRQAPG KGLEWVARIYPTNGYARYADSVKGRFTISADTSKNTAYLQM NSLRAEDTAVYYCSRWGGDGFYAMDYWGQGTLVTVSSAST KGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSC |
| SEQ ID NO: 13 - anti-HER2 FAB T57E heavy chain | EVQLVESGGGLVQPGGSLRLSCAASGFNIKDTYIHWVRQAPG KGLEWVARIYPTNGYERYADSVKGRFTISADTSKNTAYLQM NSLRAEDTAVYYCSRWGGDGFYAMDYWGQGTLVTVSSAST KGPSVFPLAPSSKSTSGGTAALGCLVKDYFPEPVTVSWNSGA LTSGVHTFPAVLQSSGLYSLSSVVTVPSSSLGTQTYICNVNHK PSNTKNDKKVEPKSC |
| SEQ ID NO: 14 - anti-HER2 scFv(G65S)-Fc 133 heavy chain | EVQLVESGGGLVQPGGSLRLSCAASGFNIKDTYIHWVRQAPG KGLEWVARIYPTNGYTRYADSVKSRFTISADTSKNTAYLQMN SLRAEDTAVYYCSRWGGDGFYAMDYWGQGTLVTVSSGGGG SGGGGSGGGGSDIQMTQSPSSLSASVGDRVTITCRASQDVNT AVAWYQQKPGKAPKLLIYSASFLYSTVPSRFSGSRSGTDFTLT ISSLQPEDFATYYCQQHYTTPPTFGQGTKVEIKRGGGGTDKTH TCPPCPAPELLGGPSVFLFPPKPKDTLMISRTPEVTCVVVDVSH EDPEVQFKWYVDGVEVHNAKTKPREEQYNSTFRVVSVLTVL HQDWLNGKEYKCKVSNKALPAPIEKTISKTKGQPREPQVYTL PPSREEMTKNQVSLTCLVKGFYPSDIAVEWESSGQPENNYNT TPPMLDSDGSFFLYSKLTVDKSRWQQGNIFSCSVMHEALHNR FTQKSLSLSPGK |
| SEQ ID NO: 15 - anti-HER2 scFv(N82aS)-Fc 133 heavy chain | EVQLVESGGGLVQPGGSLRLSCAASGFNIKDTYIHWVRQAPG KGLEWVARIYPTNGYTRYADSVKGRFTISADTSKNTAYLQMS SLRAEDTAVYYCSRWGGDGFYAMDYWGQGTLVTVSSGGGG SGGGGSGGGGSDIQMTQSPSSLSASVGDRVTITCRASQDVNT AVAWYQQKPGKAPKLLIYSASFLYSTVPSRFSGSRSGTDFTLT ISSLQPEDFATYYCQQHYTTPPTFGQGTKVEIKRGGGGTDKTH TCPPCPAPELLGGPSVFLFPPKPKDTLMISRTPEVTCVVVDVSH EDPEVQFKWYVDGVEVHNAKTKPREEQYNSTFRVVSVLTVL HQDWLNGKEYKCKVSNKALPAPIEKTISKTKGQPREPQVYTL PPSREEMTKNQVSLTCLVKGFYPSDIAVEWESSGQPENNYNT TPPMLDSDGSFFLYSKLTVDKSRWQQGNIFSCSVMHEALHNR FTQKSLSLSPGK |
| SEQ ID NO: 16 - anti-HER2 FA B(G65S)-Fc 133 heavy chain | EVQLVESGGGLVQPGGSLRLSCAASGFNIKDTYIHWVRQAPG KGLEWVARIYPTNGYTRYADSVKSRFTISADTSKNTAYLQMN SLRAEDTAVYYCSRWGGDGFYAMDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKVDKKVEPKSCDKTHTCPPCPAPELLGGPSVFLFPPKPKDT LMISRTPEVTCVVVDVSHEDPEVQFKWYVDGVEVHNAKTKP REEQYNSTFRVVSVLTVLHQDWLNGKEYKCKVSNKALPAPIE KTISKTKGQPREPQVYTLPPSREEMTKNQVSLTCLVKGFYPSD IAVEWESSGQPENNYNTTPPMLDSDGSFFLYSKLTVDKSRWQ QGNIFSCSVMHEALHNRFTQKSLSLSPGK |
| SEQ ID NO: 17 - anti-HER2 FAB(N82aS)-Fc 133 heavy chain | EVQLVESGGGLVQPGGSLRLSCAASGFNIKDTYIHWVRQAPG KGLEWVARIYPTNGYTRYADSVKGRFTISADTSKNTAYLQMS SLRAEDTAVYYCSRWGGDGFYAMDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKVDKKVEPKSCDKTHTCPPCPAPELLGGPSVFLFPPKPKDT LMISRTPEVTCVVVDVSHEDPEVQFKWYVDGVEVHNAKTKP REEQYNSTFRVVSVLTVLHQDWLNGKEYKCKVSNKALPAPIE KTISKTKGQPREPQVYTLPPSREEMTKNQVSLTCLVKGFYPSD IAVEWESSGQPENNYNTTPPMLDSDGSFFLYSKLTVDKSRWQ QGNIFSCSVMHEALHNRFTQKSLSLSPGK |
| SEQ ID NO: 18 - OKT3 heavy chain variable domain | QVQLQQSGAELARPGASVKMSCKASGYTFTRYTMHWVKQR PGQGLEWIGYINPSRGYTNYNQKFKDKATLTTDKSSSTAYMQ LSSLTSEDSAVYYCARYYDDHYCLDYWGQGTTLTVSS |
| SEQ ID NO: 19 - OKT3 light chain variable domain | QIVLTQSPAIMSASPGEKVTMTCSASSSVSYMNWYQQKSGTS PKRWIYDTSKLASGVPAHFRGSGSGTSYSLTISGMEAEDAAT YYCQQWSSNPFTFGSGTKLEIN |
| SEQ ID NO: 20 - Herceptin heavy chain variable domain | EVQLVESGGGLVQPGGSLRLSCAASGFNIKDTYIHWVRQAPG KGLEWVARIYPTNGYTRYADSVKGRFTISADTSKNTAYLQM NSLRAEDTAVYYCSRWGGDGFYAMDYWGQGTLVTVSS |

| Sequence listing | |
|---|---|
| SEQ ID NO: 21 - Herceptin light chain variable domain | DIQMTQSPSSLSASVGDRVTITCRASQDVNTAVAWYQQKPGK APKLLIYSASFLYSGVPSRFSGSRSGTDFTLTISSLQPEDFATYY CQQHYTTPPTFGQGTKVEIK |
| SEQ ID NO: 22 - Human germlime heavy chain variable domain IGHV3-23*04 | EVQLVESGGGLVQPGGSLRLSCAASGFTFSSYAMSWVRQAP GKGLEWVSAISG~~SGGSTYYADSVKGRFTISRDNSKNTLYL QMNSLRAEDTAVYYCAK |
| SEQ ID NO: 23 - Human germline light chain variable domain IGKV1-39*01 | DIQMTQSPSSLSASVGDRVTITCRASQSISSYLNWYQQKPGKA PKLLIYAASSLQSGVPSRFSGSGSGTDFTLTISSLQPEDFATYY CQQSYSTP |
| SEQ ID NO: 24 - Human germline light chain variable domain IGKV3-20*01 | EIVLTQSPGTLSLSPGERATLSCRASQSVSSSYLAWYQQKPGQ APRLLIYGASSRATGIPDRFSGSGSGTDFTLTISRLEPEDFAVY YCQQYGSSP |
| SEQ ID NO: 25 - Chimeric OKT3 heavy chain IgG1 | QVQLQQSGAELARPGASVKMSCKASGYTFTRYTMHWVKQR PGQGLEWIGYINPSRGYTNYNQKFKDKATLTTDKSSSTAYMQ LSSLTSEDSAVYYCARYYDDHYCLDYWGQGTTLTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKNDKKVEPKSCDKTHTCPPCPAPELLGGPSVFLFPPKPKDT LMISRTPEVTCVVVDVSHEDPEVKFNWYVDGVEVHNAKTKP REEQYNSTYRVVSVLTVLHQDWLNGKEYKCKVSNKALPAPI EKTISKAKGQPREPQVYTLPPSRDELTKNQVSLTCLVKGFYPS DIAVEWESNGQPENNYKTTPPVLDSDGSFFLYSKLTVDKSRW QQGNVFSCSVMHEALHNHYTQKSLSLSPGK |
| SEQ ID NO: 26 - Chimeric OKT3 human kappa tight chain | QIVLTQSPAIMSASPGEKVTMTCSASSSVSYMNWYQQKSGTS PKRWIYDTSKLASGVPAHFRGSGSGTSYSLTISGMEAEDAAT YYCQQWSSNPFTFGSGTKLEINRTVAAPSVFIFPPSDEQLKSGT ASVVCLLNNFYPREAKVQWKVDNALQSGNSQESVTEQDSKD STYSLSSTLTLSKADYEKHKVYACEVTHQGLSSPVTKSFNRG EC |
| SEQ ID NO: 27 - OKT3 humanized heavy chain with VH domain | EVQLVESGGGLVQPGGSLRLSCAASGYTFTRYTIHWVRQAPG KGLEWVAYINPSRGYTRYADSVKGRFTISADTSKNTAYLQM NSLRAEDTAVYYCARYYDDHYCLDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKVDKKVEPKSCDKTHTCPPCPAPELIGGPSVFLFPPKPKDT LMISRTPEVTCVVVDVSHEDPEVKFNWYVDGVEVHNAKTKP REEQYNSTYRVVSVLTVLHQDWLNGKEYKCKVSNKALPAPI EKTISKAKGQPREPQVYTLPPSRDELTKNQVSLTCLVKGFYPS DIAVEWESNGQPENNYKTTPPVLDSDGSFFLYSKLTVDKSRW QQGNVFSCSVMHEALHNHYTQKSLSLSPGK |
| SEQ ID NO: 28 - OKT3 humanized heavy chain with VH1 domain | EVQLVESGGGLVQPGGSLRLSCAASGYFTRYTIHWVRQAPG KGLEWVGYINPSRGYTRYADSVKGRFTISADTSKNTAYLQM NSLRAEDTAVYYCARYYDDHYCLDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKVDKKVEPKSCDKTHTCPPCPAPELLGGPSVFLFPPKPKDT LMISRTPEVTCVVVDVSHEDPEVKFNWYVDGVEVHNAKTKP REEQYNSTYRVVSVLTVLHQDWLNGKEYKCKVSNKALPAPI EKTISKAKGQPREPQVYTLPPSRDELTKNQVSLTCLVKGFYPS DIAVEWESNGQPENNYKTTPPVLDSDGSFFLYSKLTVDKSRW QQGNVFSCSVMHEALHNHYTQKSLSLSPGK |
| SEQ ID NO: 29 - OKT3 humanized heavy chain with VH2 domain | EVQLVESGGGLVQPGGSLRLSCAASGYTFTRYTMHWVRQAP GKGLEWVGYINPSRGYTRYADSVKGRFTISADTSKNTAYLQ MNSLRAEDTAVYYCARYYDDHYCLDYWGQGTLVTVSSAST KGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPELLGGPSVFLFPPKPK DTLMISRTPEVTCVVVDVSHEDPEVKFNWYVDGVEVHNAKT KPREEQYNSTYRVVSVLTVLHQDWLNGKEYKCKVSNKALPA PIEKTISKAKGQPREPQVYTLPPSRDELTKNQVSLTCLVKGFY PSDIAVEWESNGQPENNYKTTPPVLDSDGSFFLYSKLTVDKSR WQQGNVFSCSVMHEALHNHYTQKSLSLSPGK |
| SEQ ID NO: 30 - OKT3 humanized heavy chain with VH3 domain | EVQLVESGGGLVQPGGSLRLSCAASGYTFTRYTIHWVRQAPG KGLEWVGYINPSRGYTRYADSVKGRFTISTDTSKNTAYLQMN SLRAEDTAVYYCARYYDDHYCLDYWGQGTLVTVSSASTKGP |

| | |
|---|---|
| | SVFPLAPSSKSTSGGTAALGCLVKDYFPEPVTVSWNSGALTSG<br>VHTFPAVLQSSGLYSLSSVVTVPSSSLGTQTYICNVNHKPSNT<br>KVDKKVEPKSCDKTHTCPPCPAPELLGGPSVFLFPPKPKDTLM<br>ISRTPEVTCVVVDVSHEDPEVKFNWYVDGVEVHNAKTKPRE<br>EQYNSTYRVVSVLTVLHQDWLNGKEYKCKVSNKALPAPIEK<br>TISKAKGQPREPQVYTLPPSRDELTKNQVSLTCLVKGFYPSDI<br>AVEWESNGQPENNYKTTPPVLDSDGSFFLYSKLTVDKSRWQ<br>QGNVFSCSVMHEALHNHVFQKSLSLSPGK |
| SEQ ID NO: 31 - OKT3<br>humanized heavy chain<br>with VH4 domain | EVQLVESGGGLVQPGGSLRLSCAASGYTFTRYTMHWVRQAP<br>GKGLEWVGYINPSRGYTRYADSVKGRFTISTDTSKNTAYLQM<br>NSLRAEDTAVYYCARYYDDHYCLDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPS<br>NTKVDKKVEPKSCDKTHTCPPCPAPELLGGPSVFLFPPKPKDT<br>LMISRTPEVCVVVDVSHEDPEVKFNWYVDGVEVHNAKTKP<br>REEQYNSTYRVVSVLTVLHQDWLNGKEYKCKVSNKALPAPI<br>EKTISKAKGQPREPQVYTLPPSRDELTKNQVSLTCLVKGFYPS<br>DIAVEWESNGQPENNYKTTPPVLDSDGSFFLYSKLTVDKSRW<br>QQGNVFSCSVMHEALHNHYTQKSLSLSPGK |
| SEQ ID NO: 32 - OKT3<br>humanized heavy chain<br>with VH5 domain | EVQLVESGGGLVQPGGSLRLSCAASGYTFTRYTMHWVRQAP<br>GKGLEWVGYINPSRGYTRYADSVKGRFTLSTDKSKNTAYLQ<br>MNSLRAEDTAVYYCARYYDDHYCLDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSCDKTHTCPPCPAPELLGGPSVFLFPPKPK<br>DTLMISRTPEVTCVVVDVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHNHYTQKSLSLSPGK |
| SEQ ID NO: 33 - OKT3<br>humanized heavy chain<br>with VH6 domain | EVQLVESGGGLVQPGGSLRLSCAASGYTFTRYTMHWVRQAP<br>GKGLEWIGYINPSRGYTRYADSVKGRFTLSTDKSKNTAYLQM<br>NSLRAEDTAVYYCARYYDDHYCLDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPS<br>NTKVDKKVEPKSCDKTHTCPPCPAPELLGGPSVFLFPPKPKDT<br>LMISRTPEVTCYVVDVSHEDPEVKFNWYVDGVEVHNAKTKP<br>REEQYNSTYRVVSVLTVLHQDWLNGKEYKCKVSNKALPAPI<br>EKTISKAKGQPREPQVYTLPPSRDELTKNQVSLTCLVKGFYPS<br>DIAVEWESNGQPENNYKTTPPVLDSDGSFFLYSKLTVDKSRW<br>QQGNVFSCSVMHEALHNHYTQKSLSLSPGK |
| SEQ ID NO: 34 - OKT3<br>humanized heavy chain<br>with VH7 domain | EVQLVESGGGLVQPGGSLRLSCAASGYTFTRYTMHWVRQAP<br>GKGLEWVGYINPSRGYTNYADSVKGRFTLSTDKSKNTAYLQ<br>MNSLRAEDTAVYYCARYYDDHYCLDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSCDKTHTCPPCPAPELLGGPSVFLFPPKPK<br>DTILMISRTPEVTCVVVDVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHNHYTQKSLSLSPGK |
| SEQ ID NO: 35 - OKT3<br>humanized heavy chain<br>with VH8 domain | EVQLVESGGGLVQPGGSLRLSCAASGYTFTRYTMHWVRQAP<br>GKGLEWIGYINPSRGYTYYADSVKGRFTLSTDKSKNTAYLQ<br>MNSLRAEDTAVYYCARYYDDHYCLDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSCDKTHTCPPCPAPELLGGPSVFLFPPKPK<br>DTLMISRTPEVTCVVVDVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHNHNYTQKSLSLLSPGK |
| SEQ ID NO: 36 - OKT3<br>humanized heavy chain<br>with VH9 domain | EVQLVESGGGLVQPGGSLRLSCAASGYTFTRYTMHWVRQAP<br>GKGLEWIGYINPSRGYTYYADSVKSRFTLSTDKSKNTAYLQM<br>NSLRAEDTAVYYCARYYDDHYCLDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPS<br>NTKVDKKVEPKSCDKTHTCPPCPAPELLGGPSVFLFPPKPKDT<br>LMISRTPEVTCVVVDVSHEDPEVKFNWYVDGVEVHNAKTKP<br>REEQYNSTYRVVSVLTVLHQDWLNGKEYKCKVSNKALPAPI |

| | |
|---|---|
| | EKTISKAKGQPREPQVYTLPPSRDELTKNQVSLTCLVKGFYPS<br>DIAVEWESNGQPENNYKTTPPVLDSDGSFFLYSKLTVDKSRW<br>QQGNVFSCSVMHEALHNHYTQKSLSLSPGK |
| SEQ ID NO: 37 - OKT3 humanized heavy chain with VH10 domain | EVQLVESGGGLVQPGGSLRLSCAASGYTFTRYTMHWVRQAP<br>GKGLEWIGYINPSRGYTYYADSVKSRATLSTDKSKNTAYLQ<br>MNSLRAEDTAVYYCARYYDDHYCLDYWGQGTLVTVSSAST<br>KGPSVFPLAPSSKSTSGGTAALGCLVKDYFPEPVTVSWNSGA<br>LTSGVHTEPAVLQSSGLYSLSSVVTVPSSSLGTQTYICNVNHK<br>PSNTKVDKKVEPKSCDKTHTCPPCPAPELLGGPSVFLFPPKPK<br>DTLMISRTPEVTCVVVDVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHNHYTQKSLSLSPGK |
| SEQ ID NO: 38 - OKT3 humanized heavy chain with VH11 domain | EVQLVESGGGLVQPGGSLRLSCAASGYTFTRYTMHWVRQAP<br>GKGLEWIGYINPSRGYTYYADSVKGRFTLSTDKSKNTAYLQ<br>MSSLRAEDTAVYYCARYYDDHYCLDYWGQGTLVTVSSAST<br>KGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSCDKTHTCPPCPAPELLGGPSVFLFPPKPK<br>DTLMISRTPEVTCVVVDVSHEDPEVKFNWYVDGVEVHNAKT<br>KPREEQYNSTYRVVSVLTVLHQDWLNGKEYKCKVSNKALPA<br>PIEKTISKAKGQPREPQVYTLPPSRDELTKNQVSLTCLVKGFY<br>PSDIAVEWESNGQPENNYKTTPPVLDSDGSFFLYSKLTVDKSR<br>WQQGNVFSCSVMHEALHNHYTQKSLSLSPGK |
| SEQ ID NO: 39 - OKT3 humanized light chain with VL domain | DIQMTQSPSSLSASVGDRVTITCRASSSVSYVAWYQQKPGKA<br>PKLLIYDTSKLYSGVPSRFSGSRSGTDFTLTISSLQPEDFATYY<br>CQQWSSNPPTFGQGTKVEIKRTVAAPSVFIFPPSDEQLKSGTA<br>SVVCLLNNFYPREAKVQWKVDNALQSGNSQESVTEQDSKDS<br>TYSLSSTLTLSKADYEKHKVYACEVTHQGLSSPVTKSFNRGE<br>C |
| SEQ ID NO: 40 - OKT3 humanized light chain with VL1 domain | DIQMTQSPSSLSASVGDRVTITCRASSSVSYVAWYQQKPGKA<br>PKLLIYDTSKLYSGVPSRFSGSRSGTDYTLTISSLQPEDFATYY<br>CQQWSSNPPTFGQGTKVEIKRTVAAPSVFIFPPSDEQLKSGTA<br>SVVCLLNNFYPREAKVQWKVDNALQSGNSQESVTEQDSKDS<br>TYSLSSTLTLSKADYEKHKVYACEVTHQGLSSPVTKSFNRGE<br>C |
| SEQ ID NO: 41 - OKT3 humanized light chain with VL2 domain | DIQLTQSPSSLSASVGDRVTITCRASSSVSYVAWYQQKPGKAP<br>KLLIYDTSKLYSGVPSRFSGSRSGTDFTLTISSLQPEDFATYYC<br>QQWSSNPPTFGQGTKVEIKRTVAAPSVFIFPPSDEQLKSGTAS<br>VVCLLNNFYPREAKVQWKVDNALQSGNSQESVTEQDSKDST<br>YSLSSTLTLSKADYEKHKVYACEVTHQGLSSPVTKSFNRGEC |
| SEQ ID NO: 42 - OKT3 humanized light chain with VL3 domain | DIQLTQSPSSLSASVGDRVTITCRASSSVSYVAWYQQKPGKAP<br>KLLIYDTSKLYSGVPSRFSGSRSGTDYTLTISSLQPEDFATYYC<br>QQWSSNPPTFGQGTKVEIKRTVAAPSVFIFPPSDEQLKSGTAS<br>VVCLLNNFYPREAKVQWKVDNALQSGNSQESVTEQDSKDST<br>YSLSSTLTLSKADYEKHKVYACEVTHQGLSSPVTKSFNRGEC |
| SEQ ID NO: 43 - OKT3 humanized light chain with VL4 domain | DIQLTQSPSSLSASVGDRVTITCRASSSVSYVAWYQQKPGKAP<br>KRWIYDTSKLYSGVPSRFSGSRSGTDYTLTISSLQPEDFATYY<br>CQQWSSNPPTFGQGTKVEIKRTVAAPSVFIFPPSDEQLKSGTA<br>SVVCLLNNFYPREAKVQWKVDNALQSGNSQESVTEQDSKDS<br>TYSLSSTLTLSKADYEKHKVYACEVTHQGLSSPVTKSFNRGE<br>C |
| SEQ ID NO: 44 - OKT3 humanized light chain with VL5 domain | DIQLTQSPSSLSASVGDRVTITCRASSSVSYMNWYQQKPGKA<br>PKLLIYDTSKLYSGVPSRFSGSRSGTDYTLTISSLQPEDFATYY<br>CQQWSSNPPTFGQGTKVEIKRTVAAPSVFIFPPSDEQLKSGTA<br>SVVCLLNNFYPREAKVQWKVDNALQSGNSQESVTEQDSKDS<br>TYSLSSTLTLSKADYEKHKVYACEVTHQGLSSPVTKSFNRGE<br>C |
| SEQ ID NO: 45 - OKT3 humanized light chain with VL6 domain | DIQLTQSPSSLSASVGDRVTITCRASSSVSYVAWYQQKPGKAP<br>KRWIYDTSKLYSGVPSRFSGSRSGTDYTLTISSLQPEDFATYY<br>CQQWSSNPFTFGQGTKVEIKRTVAAPSVFIFPPSDEQLKSGTA<br>SVVCLLNNFYPREAKVQWKVDNALQSGNSQESVTEQDSKDS<br>TYSLSSTLTLSKADYEKHKVYACEVTHQGLSSPVTKSFNRGE<br>C |

| Sequence listing | |
|---|---|
| SEQ ID NO: 46 - OKT3 humanized light chain with VL7 domain | DIQLTQSPSSLSASVGDRVTITCRASSSVSYMNWYQQKPGKA PKLLIYDTSKLYSGVPSRFSGSRSGTDYTLTISSLQPEDFATYY CQQWSSNPFTFGQGTKVEIKRTVAAPSVFIFPPSDEQLKSGTA SVVCLLNNFYPREAKVQWKVDNALQSGNSQESVTEQDSKDS TYSLSSTLTLSKADYEKHKVYACEVTHQGLSSPVTKSENRGE C |
| SEQ ID NO: 47 - OKT3 humanized light chain with VL8 domain | DIQLTQSPSSLSASVGDRVTITCRASSSVSYVAWYQQKPGKAP KRWIYDTSKLYSGVPSRFSGSGSGTDYTLTISSLQPEDFATYY CQQWSSNPPTFGQGTKVEIKRTVAAPSVFIFPPSDEQLKSGTA SVVCLLNNFYPREAKVQWKVDNALQSGNSQESVTEQDSKDS TYSLSSTLTLSKADYEKHKVYACEVTHQGLSSPVTKSFNRGE C |
| SEQ ID NO: 48 - OKT3 humanized VH8 domain | EVQLVESGGGLVQPGGSLRLSCAASGYTFTRYTMHWVRQAP GKGLEWIGYINPSRGYTYYADSVKGRFTLSTDKSKNTAYLQ MNSLRAEDTAVYYCARYDDHYCLDYWGQGTLVTVSS |
| SEQ ID NO: 49 - OKT3 humanized VH11 domain | EVQLVESGGGLVQPGGSERLSCAASGYTFTRYTMHWVRQAP GKGLEWIGYINPSRGYTYYADSVKGRFTLSTDKSKNTAYLQ MSSLRAEDTAVYYCARYDDHYCLDYWGQGTLVTVSS |
| SEQ ID NO: 50 - OKT3 humanized VlA domain | DIQLTQSPSSLSASVGDRVTITCRASSSVSYVAWYQQKPGKAP KRWIYDTSKLYSGVPSRFSGSRSGTDYTLTISSLQPEDFATYY CQQWSSNPPTFGQGTKVEIK |
| SEQ ID NO: 51 - OKT3 humanized VL8 domain | DIQLTQSPSSLSASVGDRVTITCRASSSVSYVAWYQQKPGKAP KRWIYDTSKLYSGVPSRFSGSGSGTDYTLTISSLQPEDFATYY CQQWSSNPPTFGQGTKVEIK |
| SEQ ID NO: 52 - scFv fragment mouse OKT3 - human IgG1 Fc fusion | QVQLQQSGAELARPGASVKMSCKASGYTFTRYTMHWVKQR PGQGLEWIGYINPSRGYTNYNQKFKDKATLTTDKSSSTAYMQ LSSLTSEDSAVYYCARYDDHYCLDYWGQGTTLTVSSGGGG SGGGGSGGGGSQIVLTQSPAIMSASPGEKVTMTCSASSSVSY MNWYQQKSGTSPKRWIYDTSKLASGVPAHFRGSGSGTSYSL TISGMEAEDAATYYCQQWSSNPFTFGSGTKLEINGGGGTDKT HTCPPCPAPELLGGPSVFLFPPKPKDTLMISRTPEVTCVVVDVS HEDPEVKFNWYVDGVEVHNAKTKPREEQYNSTYRVVSVLTV LHQDWLNGKEYKCKVSNKALPAPIEKTISKAKGQPREPQVYT LPPSRDELTKNQVSLTCLVKGFYPSDIAVEWESNGQPENNYK TTPPVLDSDGSFFLYSKLTVDKSRWQQGNVFSCSVMHEALHN HYTQKSLSLSPGK |
| SEQ ID NO: 53 - scFv fragment humanized OKT3 VH5-VL3 - human IgG1 Fc fusion | EVQLVESGGGLVQPGGSLRLSCAASGYTFTRYTMHWVRQAP GKGLEWVGYINPSRGYTRYADSVKGRFTLSTDKSKNTAYLQ MNSLRAEDTAVYYCARYDDHYCLDYWGQGTLVTVSSGGG GSGGGGSGGGGSGGGASDIQLTQSPSSLSASVGDRVTITCRAS SSVSYVAWYQQKPGKAPKLLIYDTSKLYSGVPSRFSGSRSGT DYTLTISSLQPEDFATYYCQQWSSNPPTFGQGTKVEIKGGGGT DKTHTCPPCPAPELLGGPSVFLFPPKPKDTLMISRTPEVTCVV VDVSHEDPEVKFNWYVDGVEVHNAKTKPREEQYNSTYRVV SVLTVLHQDWLNGKEYKCKVSNKALPAPIEKTISKAKGQPRE PQVYTLPPSRDELTKNQVSLTCLVKGFYPSDIAVEWESNGQPE NNYKTTPPVLDSDGSFFLYSKLTVDKSRWQQGNVFSCSVMH EALHNHYTQKSLSLSPGK |
| SEQ ID NO: 54 - scFv fragment humanized OKT3 -VH6-VL4 - human IgG1 Fc fusion | EVQLVESGGGLVQPGGSLRLSCAASGYTFTRYTMHWVRQAP GKGLEWIGYINPSRGYTRYADSVKGRFTLSTDKSKNTAYLQM NSLRAEDTAVYYCARYDDHYCLDYWGQGTLVTVSSGGGG SGGGGSGGGGSGGGASDIQLTQSPSSLSASVGDRVTITCRASS SVSYVAWYQQKPGKAPKRWIYDTSKLYSGVPSRFSGSRSGTD YTLTISSLQPEDFATYYCQQWSSNPPTFGQGTKVEIKGGGGTD KTHTCPPCPAPELLGGPSVFLFPPKPKDTLMISRTPEVTCVVV DVSHEDPEVKFNWYVDGVEVHNAKTKPREEQYNSTYRVVS VLTVLHQDWLNGKEYKCKVSNKALPAPIEKTISKAKGQPREP QVYTLPPSRDELTKNQVSLTCLVKGFYPSDIAVEWESNGQPE NNYKTTPPVLDSDGSFFLYSKLTVDKSRWQQGNVFSCSVMH EALHNHYTQKSLSLSPGK |
| SEQ ID NO: 55 - scFv fragment humanized OKT3 -VH16-VL5 - human IgG1 Fc fusion | EVQLVESGGGLVQPGGSLRLSCAASGYTFTRYTMHWVRQAP GKGLEWIGYINPSRGYTRYADSVKGRFTLSTDKSKNTAYLQM NSLRAEDTAVYYCARYDDHYCLDYWGQGTLVTVSSGGGG SGGGGSGGGGSGGGASDIQLTQSPSSLSASVGDRVTITCRASS SVSYMNWYQQKPGKAPKLLIYDTSKLYSGVPSRFSGSRSGTD YTLTISSLQPEDFATYYCQQWSSNPPTFGQGTKVEIKGGGGTD KTHTCPPCPAPELLGGPSVFLFPPKPKDTLMISRTPEVTCVVV |

| | |
|---|---|
| | DVSHEDPEVKFNWYVDGVEVHNAKTKPREEQYNSTYRVVS<br>VLTVLHQDWLNGKEYKCKVSNKALPAPIEKTISKAKGQPREP<br>QVYTLPPSRDELTKNQVSLTCLVKGFYPSDIAVEWESNGQPE<br>NNYKTTPPVLDSDGSFFLYSKLTVDKSRWQQGNVFSCSVMH<br>EALHNHYTQKSLSLSPGK |
| SEQ ID NO: 56 - scFv<br>fragment humanized<br>OKT3 VH8-VL4 -<br>human IgG1 Fc fusion | EVQLVESGGGLVQPGGSLRLSCAASGYTFTRYTMHWVRQAP<br>GKGLEWIGYINPSRGYTYYADSVKGRFTLSTDKSKNTAYLQ<br>MNSLRAEDTAVYYCARYYDDHYCLDYWGQGTLVTVSSGGG<br>GSGGGGSGGGGSGGGASDIQLTQSPSSLSASVGDRVTITCRAS<br>SSVSYMYAWYQQKPGKAPKRWIYDTSKLYSGVPSRFSGSRSGT<br>DYTLTISSLQPEDFATYYCQQWSSNPPTFGQGTKVEIKggggtdkt<br>htcppcpapellggpsvflfppkpkdtlmisrtpevtcvvvdvshedpevkfnwyvdgvev<br>hnaktkpreeqynstyrvvsvltvlhqdwlngkeykckvsnkalpapiektiskakgqprep<br>qvytlppsrdeltknqvsltclvkgfypsdiavewesngqpennykttppvldsdgsfflysklt<br>vdksrwqqgnvfscsvmhealhnhytqkslslspgk |
| SEQ ID NO: 57 - scFv<br>fragment humanized<br>OKT3 VH8-VL8 -<br>human IgG1 Fc fusion | EVQLVESGGGLVQPGGSLRLSCAASGYTFTRYTMHWVRQAP<br>GKGLEWIGYINPSRGYTYYADSVKGRFTLSTDKSKNTAYLQ<br>MNSLRAEDTAVYYCARYYDDHYCLDYWGQGTLVTVSSGGG<br>GSGGGGSGGGGSGGGASDIQLTQSPSSLSASVGDRVTITCRAS<br>SSVSYMYAWYQQKPCKAPKRWIYDTSKLYSGVPSRFSGSGSGT<br>DYTLTISSLQPEDFATYYCQQWSSNPPTFGQGTKVEIKggggtdkt<br>htcppcpapellggpsvflfppkpkdtlmisrtpevtcvvvdvshedpevkfnwyvdgvev<br>hnaktkpreeqynstryvsvltvlhqdwlngkeykckvsnkalpapiektiskakgqprep<br>qvytlppsrdeltknqvsltclvkgfypsdiavewesngqpennykttppvldsdgsfflysklt<br>vdksrwqqgnvfscsvmhealhnhytqkslslspgk |
| SEQ ID NO: 58 - scFv<br>fragment humanized<br>OKT3 VH8-VL4 | EVQLVESGGGLVQPGGSLRLSCAASGYTFTRYTMHWVRQAP<br>GKGLEWIGYINPSRGYTYYADSVKGRFTLSTDKSKNTAYLQ<br>MNSLRAEDTAVYYCARYYDDHYCLDYWGQGTLVTVSSGGG<br>GSGGGGSGGGGSGGGASDIQLTQSPSSLSASVGDRVTITCRAS<br>SSVSYMYAWYQQKPGKAPKRWIYDTSKLYSGVPSRFSGSRSGT<br>DYTLTISSLQPEDFATYYCQQWSSNPPTFGQGTKVEIK |
| SEQ ID NO: 59 - scFv<br>fragment humanized<br>OKT3 VH8-VL8 | EVQLVESGGGLVQPGGSLRLSCAASGYTFTRYTMHWVRQAP<br>GKGLEWIGYINPSRGYTYYADSVKGRFTISTDKSKNTAYLQ<br>MNSLRAEDTAVYYCARYYDDHYCLDYWGQGTLVTVSSGGG<br>GSGGGGSGGGGSGGGASDIQLTQSPSSLSASVGDRVTITCRAS<br>SSVSYMYAWYQQKPGKAPKRWIYDTSKLYSGVPSRFSGSGSGT<br>DYTLTISSLQPEDFATYYCQQWSSNPPTFGQGTKVEIK |
| SEQ ID NO: 60 - Mouse<br>anti-human CD3 epsilon<br>SP34 VH domain | EVQLVESGGGLVQPKGSLKLSCAASGFTFNTYAMNWVRQAP<br>GKGLEWVARIRSKYNNYATYYADSVKDRFTISRDDSQSILYL<br>QMNNLKTEDTAMYYCVRHGNFGNSYVSWFAYWGQGTLVT<br>VSA |
| SEQ ID NO: 61 - Mouse<br>anti-human CD3 epsilon<br>SP34 VL domain | QAVVTQESALTTSPGETVTLTCRSS~TGAVTTSNYANWVQEK<br>PDHLFTGLIGGTNKRAPGVPARFSGSLIGDKAALTITGAQTED<br>EAIYCALWYSNLWVFGGGTKLTVL |
| SEQ ID NO: 62 -<br>Chimeric SP34 heavy<br>chain IgG1 | EVQLVESGGGLVQPKGSLKLSCAASGFTFNTYAMNWVRQAP<br>GKGLEWVARIRSKYNNYATYYADSVKDRFTISRDDSQSILYL<br>QMNNLKTEDTAMYYCVRHGNFGNSYVSWFAYWGQGTLVT<br>VSAASTKGPSVFPLAPSSKSTSGGTAALGCLVKDYFREPVTVS<br>WNSGALTSGVHTFPAVLQSSGLYSLSSVVTVPSSSLGTQTYIC<br>NVNHKPSNTKVDKKVEPKSCDKTHTCPPCPAPELLGGPSVFL<br>FPPKPKDTLMISRTPEVTCVVVDVSHEDPEVKFNWYVDGVEV<br>HNAKTKPREEQYNSTYRVVSVLTVLHQDWLNGKEYKCKVS<br>NKALPAPIEKTISKAKGQPREPQVYTLPPSRDELTKNQVSLTC<br>LVKGFYPSDIAVEWESNGQPENNYKTTPPVLDSDGSFFLYSKL<br>TVDKSRWQQGNVFSCSVMHEALHNHYTQKSLSLSPGK |
| SEQ ID NO: 63 -<br>Chimeric SP34 light<br>chain (mouse V lambda -<br>human lambda<br>constant domain) | QAVVTQESA~LTTSPGETVTLTCRSSTGAVTTSNYANWVQEK<br>PDHLFTGLIGGTNKRAPGVPARFSGSLIGDKAALTITGAQTED<br>EAIYFCALWYSNLWVFGGGTKLTVLRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 64 - SP34<br>humanized heavy chain<br>with VH1 domain | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSWFAYWGQGTTVT<br>VSSASTKGPSVFPLAPSSKSTSGGTAALGCLVKDYFPEPVTVS<br>WNSGALTSGVHTFPAVLQSSGLYSLSSVVTVPSSSLGTQTYIC<br>NVNHKPSNTKVDKKVEPKSCDKTHTCPPCPAPELLGGPSVFL<br>FPPKPKDTLMISRTPEVTCVVVDVSHEDPEVKFNWYVDGVEV |

| | |
|---|---|
| | HNAKTKPREEQYTNSTYRVVSVLTVLHQDWLNGKEYKCKVS<br>NKALPAPIEKTISKAKGQPREPQVYTLPPSRDELTKNQVSLTC<br>LVKGFYPSDIAVEWESNGQPENNYKTTPPVLDSDGSFFLYSKL<br>TVDKSRWQQGNVFSCSVMHEALHNHYTQKSLSLSPGK |
| SEQ ID NO: 65 - SP34<br>humanized heavy chain<br>with VH2 domain | EVQLVESGGGLVQPGGSLRLSCAASGFTFNTYAMNWVRQAP<br>GKGLEWVARIRSKYNNYATYYADSVKSRFTISRDDSKNTLYL<br>QMNSLRAEDTAVYYCVRHGNFGNSYVSWFAYWGQGTTVTV<br>SSASTKGPSVFPLAPSSKSTSGGTAALGCLVKDYFPEPVTVSW<br>NSGALTSGVHTFPAVLQSSGLYSLSSVVTVPSSSLGTQTYICN<br>VNHKPSNTKVDKKVEPKSCDKTHTCPPCPAPELLGGPSVFLFP<br>PKPKDTLMISRTPEVTCVVVDVSHEDPEVKFNWYVDGVEVH<br>NAKTKPREEQYNSTYRVVSVLTVLHQDWLNGKEYKCKVSN<br>KALPAPIEKTISKAKGQPREPQVYTLPPSRDELTKNQVSLTCL<br>VKGFYPSDIAVEWESNGQPENNYKTTPPVLDSDGSTFFLYSKLT<br>VDKSRWQQGNVFSCSVMHEALHNHYTQKSLSLSPGK |
| SEQ ID NO: 66 - SP34<br>humanized heavy chain<br>with VH3 domain | EVQLVESGGGLVQPGGSLRLSCAASGFTFNTYAMNWVRQAP<br>GKGLEWVARIRSKYNNYATYYADSVKSRFTISRDDSKNTLYL<br>QMNSLRAEDTAVYYCVRHGNFGNSYVSYFAYWGQGTTVTV<br>SSASTKGPSVFPLAPSSKSTSGGTAALGCLVKDYFPEPVTVSW<br>NSGALTSGVHTFPAVLQSSGLYSLSSVVTVPSSSLGTQTYICN<br>VNHKPSNTKVDKKVEPKSCDKTHTCPPCPAPELLGGPSVFLFP<br>PKPKDTLMISRTPEVTCVVVDVSHEDPEVKFNWYVDGVEVH<br>NAKTKPREEQYNSTYRVVSVLTVLHQDWLNGKEYKCKVSN<br>KALPAPIEKTISKAKGQPREPQVYTLPPSRDELTKNQVSLTCL<br>VKGFYPSDIAVEWESNGQPENNYKTTPPVLDSDGSFFLYSKLT<br>VDKSRWQQGNVFSCSVMHEALHNHYTQKSLSTSPGK |
| SEQ ID NO: 67 - SP34<br>humanized heavy chain<br>with VH4 domain | EVQLVESGGGLVQPGGSLRLSCAASGFTFNTYAMNWVRQAP<br>GKGLEWVARIRSKYNNYATYYADSVKSRFTISRDDSKNTLYL<br>QMNSLRAEDTAVYYCVRHGNFGNSYVSFFAYWGQGTTVTV<br>SSASTKGPSVFPLAPSSKSTSGGTAALGCLVKDYFPEPVTVSW<br>NSGALTSGVHTFPAVLQSSGLYSLSSVVTVPSSSLGTQTYICN<br>VNHKPSNTKVDKKVEPKSCDKTHTCPPCPAPELLGGPSVFLFP<br>PKPKDTLMISRTPEVTCVVVDVSHEDPEVKFNWYVDGVEVH<br>NAKTKPREEQYNSTYRVVSVLTVLHQDWLNGKEYKCKVSN<br>KALPAPIEKTISKAKGQPREPQVYTLPPSRDELTKNQVSLTCL<br>VKGFYPSDIAVEWESNGQPENNYKTTPPVLDSDGSFFLYSKLT<br>VDKSRWQQGNVFSCSVMHEALHNHYTQKSLSLSPGK |
| SEQ ID NO: 68 - SP34<br>humanized heavy chain<br>with VH5 domain | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSYFAYWGQGTTVT<br>VSSASTKGPSVFPLAPSSKSTSGGTAALGCLVKDYFPEPVTVS<br>WNSGALTSGVHTFPAVLQSSGLYSLSSVVTVPSSSLGTQTYIC<br>NVNHKPSNTKVDKKVEPKSCDKTHTCPPCPAPELLGGPSVFL<br>FPPKPKDTLMISRTPEVTCVVVDVSHEDPEVKFNWYYDGVEV<br>HNAKTKPREEQYNSTYRVVSVLTVLHQDWLNGKEYKCKVS<br>NKALPAPIEKTISKAKGQPREPQVYTLPPSRDELTKNQVSLTC<br>LVKGFYPSDIAVEWESNGQPENNYKTTPPVLDSDGSFFLYSKL<br>TVDKSRWQQGNVFSCSVMHEALHNHYTQKSLSLSPGK |
| SEQ ID NO: 69 - SP34<br>humanized light chain<br>with VL1 domain | EAVVTQSPATLSVSPGERATLSCRSSTGAVTTSNYANWVQEK<br>PGQAFRGLIGGANKRAPGVPARFSGSLSGDEATLTISSLQSED<br>FAVYFCQLWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 70 - SP34<br>humanized light chain<br>with VL2 domain | EAVVTQSPATLSVSPGERATLSCRSSTGAVTTSNYANWVQEK<br>PGQAFRGLIGGANKRAPGVPARFSGSLSGDEATLTISSLQSED<br>FAVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 71 - SP34<br>humanized light chain<br>with VL3 domain | EAVVTQS~ATLSVSPGERATLSCRSSTGAVTTSNYANWVQEK<br>PGQAFRGLIGGANKRAPGVPARFSGSLSGDEATLTISSLQSED<br>FAVYFCQLWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 72 - SP34<br>humanized light chain<br>with VL4 domain | EAVVTQS~ATLSVSPGERATLSCRSSTGAVTTSNYANWVQEK<br>PGQAFRGLIGGANKRAPGVPARFSGSLSGDEATLTISSLQSED<br>FAVYFCALWYSNLWVFGQGTKLEIKRTVAAPSVFIFPPSDEQL |

| | Sequence listing |
|---|---|
| | KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 73 - SP34<br>humanized light chain<br>with VL5 domain | EIVVTQSPATLSVSPGERATLSCRSSTGAVTTSNYANWVQEKP<br>GQAFRGLIGGANKRAPGVPARFSGSLSGDEATLTISSLQSEDF<br>AVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 74 - SP34<br>humanized light chain<br>with VL6 domain | EAVVTQSPATLSVSPGERATLSCRSSTGAVTTSNYANWVQEK<br>PGQAPRGLIGGANKRAPGVPARFSGSLSGDEATLTISSLQSED<br>FAVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 75 - SP34<br>humanized light chain<br>with VL7 domain | EIVVTQSPATLSVSPGERATLSCRSSTGAVTTSNYANWVQEKP<br>GQAPRGLIGGANKRAPGVPARFSGSLSGDEATLTISSLQSEDF<br>AVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 76 - SP34<br>humanized light chain<br>with VL8 domain | EAVVTQSPATLSVSPGERATLSCRSSTGAVTTSNYANWVQEK<br>PGQAFRGLIGGANKRAPGVPARFSGSGSGDEATLTISSLQSED<br>FAVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 77 - SP34<br>humanized light chain<br>with VL9 domain | EIVVTQSPATLSVSPGERATLSCRSSTGAVTTSNYANWVQEKP<br>GQAFRGLIGGANKRAPGVPARFSGSGSGDEATLTISSLQSEDF<br>AVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 78 - SP34<br>humanized light chain<br>with VL10 domain | EAVVTQSPATLSVSPGERATLSCRSSTGAVTTSNYANWVQEK<br>PGQAFRGLIGGANKRAPGVPARFSGSLSGDEATLTISSLQSED<br>FAVYYCALWYSNLWVFGQGTKLEIKRTVAAPSVFIFPPSDEQ<br>LKSGTASVVCLLNNFYPREAKVQWKVDNALQSGNSQESVTE<br>QDSKDSTYSLSSTLTLSKADYEKHKVYACEVTHQGLSSPVTK<br>SFNRGEC |
| SEQ ID NO: 79 - SP34<br>humanized light chain<br>with VL11 domain | EAVVTQSPATLSVSPGERATLSCRSSTGAVTTSNYANNWVQEK<br>PGQAFRGLIGGANKRAPGVPARFSGSGSGTEATLTISSLQSED<br>FAVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 80 - SP34<br>humanized light chain<br>with VL12 domain | EAVVTQSPATLSVSPGERATLSCRSSTGAVTTSNYANWVQEK<br>PGQAFRGLIGGANKRAPGVPARFSGSLSGTEATLTISSLQSEDF<br>AVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 81 - SP34<br>humanized light chain<br>with VL13 domain | EAVVTQSPATLSVSPGERATLSCRASTGAVTTSNYANWVQEK<br>PGQAFRGLIGGANKRAPGVPARFSGSLSGDEATLTISSLQSED<br>FAVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 82 - SP34<br>humanized light chain<br>with VL14 domain | EAVVTQSPATLSVSPGERATLSCRSSTGAVTTSNYANWVQEK<br>PGQAFRLLIGGANKRAPGVPARFSGSLSGDEATLTISSLQSEDF<br>AVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 83 - SP34<br>humanized light chain<br>with VL15 domain | EAVVTQSPATLSVSPGERATLSCRSSTGAVTTSNYANWVQQK<br>PGQAFRGLIGGANKRAPGVPARFSGSLSGDEATLTISSLQSED<br>FAVYFCALWYSNLWVFGQGTKLEIKRTVAAPSVFIFPPSDEQL |

| | |
|---|---|
| | KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 84 - SP34<br>humanized light chain<br>with VL16 domain | EIVVTQSPATLSVSPGERATLSCRSSTGAVTTSNYANWVQEKP<br>GQAFRGLIGGANKRAPGVPARFSGSLSGTEATLTISSLQSEDF<br>AVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 85 - SP34<br>humanized tight chain<br>with VL17 domain | EIVVTQSPATLSVSPGERATLSCRASTGAVTTSNYANWVQEK<br>PGQAFRGLIGGANKRAPGVPARFSGSLSGDEATLTISSLQSED<br>FAVYFCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 86 - SP34<br>humanized light chain<br>with VL18 domain | EIVVTQSPATLSVSPGERATLSCRSSTGAVTTSNYANWVQEKP<br>GQAFRGLIGGANKRAPGVPARFSGSLSGDEATLTISSLQSEDF<br>AVYFCALWYSNLWVFGGGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 87 - SP34<br>humanized light chain<br>with VL19 domain | EIVVTQSPATLSVSPGERATLSCRSSTGAVTTSNYANWVQEKP<br>GQAFRGLIGGANKRAPGVPARFSGSLSGTEATLTISSLQSEDF<br>AVYYCALWYSNLWVFGQGTKLEIKRTVAAPSVFIFPPSDEQL<br>KSGTASVVCLLNNFYPREAKVQWKVDNALQSGNSQLSVTEQ<br>DSKDSTYSLSSTLTLSKADYEKHKVYACEVTHQGLSSPVTKS<br>FNRGEC |
| SEQ ID NO: 88 - SP34<br>humanized light chain<br>with VL20 domain | EIVVTQSPATLSVSPGERATLSCRSSTGAVTTSNYANWVQQK<br>PGQAFRGLIGGANKRAPGVPARFSGSLSGTEATLTISSLQSEDF<br>AVYYCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 89 - SP34<br>humanized light chain<br>with VL21 domain | EIVVTQSPATLSVSPGERATLSCRSSTGAVTTSNYANWVQEKP<br>GQAFRGLIGGANKRAPGVPARFSGSLSGDEATLTISSLQSEDF<br>AVYYCALWYSNLWVFGQGTKLEIKRTVAAPSVFIFPPSDEQL<br>KSGTASVVCLLNNFYPREAKVQWKVDNALQSGNSQESVTEQ<br>DSKDSTYSLSSTLTLSKADYEKHKVYACEVTHQGLSSPVTKS<br>FNRGEC |
| SEQ ID NO: 90 - SP34<br>humanized light chain<br>with VL22 domain | EIVVTQSPATLSVSPGERATLSCRSSTGAVTTSNYANWVQQK<br>PGQAFRGLIGGANKRAPGVPARFSGSLSGDEATLTISSLQSED<br>FAVYYCALWYSNLWVFGQGTKLEIKRTVAAPSVFIFPPSDEQ<br>LKSGTASVVCLLNNFYPREAKVQWKVDNALQSGNSQESVTE<br>QDSKDSTYSLSSTLTLSKADYEKHKVYACEVTHQGLSSPVTK<br>SFNRGEC |
| SEQ ID NO: 91 - scFv<br>fragment humanized<br>SP34 VH2-VL21 -<br>human IgG1 Fc fusion | EVQLVESGGGLVQPGGSLRLSCAASGFTNTYAMNWVRQAP<br>GKGLEWVARIRSKYNNYATYYADSVKSRFTISRDDSKNTLYL<br>QMNSLRAEDTAVYYCVRHGNFGNSYVSWFAYWGQGTTVTV<br>SSGGGGSGGGGSGGGGSEIVVTQSPATLSVSPGERATLSCRSS<br>TGAVTTSNYANWVQEKPGQAFRGLIGGANKRAPGVPARFSG<br>SLSGDEATLTISSLQSEDFAVYYCALWYSNLWVFGQGTKLEI<br>KGGGGTDKTHTCPPCPAPELLGGPSVFLFPPKPKDTLMISRTP<br>EVTCVVVDVSHEDPEVKFNWYVDGVEVHNAKTKPREEQYN<br>STYRVVSVLTVLHQDWLNGKEYKCKVSNKALPAPIEKTISKA<br>KGQPREPQVYTLPPSRDELTKNQVSLTCLVKGFYPSDIAVEW<br>ESNGQPENNYKTTPPVLDSDGSFFLYSKLTVDKSRWQQGNVF<br>SCSVMHEALHNHYTQKSLSLSPGK |
| SEQ ID NO: 92 - scfv<br>fragment humanized<br>SP34 VH3-VL23 -<br>human IgG1 Fc fusion | EVQLVESGGGLVQPGGSLRLSCAASGFTFNTYAMNWVRQAP<br>GKGLEWVARIRSKYNNYATYYADSVKSRFTISRDDSKNTLYL<br>QMNSLRAEDTAVYYCVRHGNFGNSYVSYFAYWGQGTTVTV<br>SSGGGGSGGGGSGGGGSEIVVTQSPATLSVSPGERATLSCRSS<br>TGAVTTSNYANWVQEKPGQAFRGLIGGANKRAPGVPARFSG<br>SLSGDEATLTISSLQSEDFAVYYCALFYSNLWVFGQGTKLEIK<br>GGGGTDKTHTCPPCPAPELLGGPSVFLFPPKPKDTLMISRTPE<br>VTCVVVDVSHEDPEVKFNWYVDGVEVHNAKTKPREEQYNS |

| | |
|---|---|
| | TYRVVSVLTVLHQDWLNGKEYKCKVSNKALPAPIEKTISKAK<br>GQPREPQVYTLPPSRDELTKNQVSLTCLVKGFYPSDIAVEWES<br>NGQPENNYKTTPPVLDSDGSFFLYSKLTVDKSRWQQGNVFSC<br>SVMHEALHNHYTQKSLSLSPGK |
| SEQ ID NO: 93 - scFv<br>fragment humanized<br>SP34 VH4-VL23 -<br>human IgG1 Fc fusion | EVQLVESGGGLVQPGGSLRLSCAASGFTFNTYAMNWVRQAP<br>GKGLEWVARIRSKYNNYATYYADSVKSRFTISRDDSKNTLYL<br>QMNSLRAEDTAVYYCVRHGNFGNSYVSFFAYWGQGTTVTV<br>SSGGGGSGGGGSGGGGSEIVVTQSPATLSVSPGERATLSCRSS<br>TGAVTTSNYANWVQEKPGQAFRGLIGGANKRAPGVPARFSG<br>SLSGDEATLISSLQSEDFAVYYCALFYSNLWVFGQGTKLEIK<br>GGGGTDKTHTCPPCPAPELLGGPSVFLFPPKPKDTLMISRTPE<br>VTCVVVDVSHEDPEVKFNWYVDGVEVHNAKTKPREEQYNS<br>TYRVVSVLTVLHQDWLNGKEYKCKVSNKALPAPIEKTISKAK<br>GQPREPQVYTLPPSRDELTKNQVSLTCLVKGFYPSDIAVEWES<br>NGQPENNYKTTPPVLDSDGSFFLYSKLTVDKSRWQQGNVFSC<br>SVMHEALHNHYTQKSLSLSPGK |
| SEQ ID NO: 94 - scFv<br>fragment humanized<br>SP34 VH5-VL23 -<br>human IgG1 Fc fusion | EVQLVESGGGLVQPGGSLRLSCAASGFTFNTYAMNWVRQAP<br>GKGLEWVARIRSKYNNYATYYADSVKGRFTISRDDSKNTLY<br>LQMNSERAEDTAVYYCVRHGNFGNSYVSYFAYWGQGTTVT<br>VSSGGGGSGGGGSGGGGSEIVVTQSPATLSVSPGERATLSCRS<br>STGAVTTSNYANWVQEKPGQAFRGLIGGANKRAPGVPARFS<br>GSLSGDEATLTISSLQSEDFAVYYCALFYSNLWVFGQGTKLEI<br>KGGGGTDKTHTCPPCPAPELLGGPSVFLFPPKPKDTLMISRTP<br>EVTCVVVDVSHEDPEVKFNWYVDGVEVHNAKTKPREEQYN<br>STYRVVSVLTVLHQDWLNGKEYKCKVSNKALPAPIEKTISKA<br>KGQPREPQVYTLPPSRDELTKNQVSLTCLVKGFYPSDIAVEW<br>ESNGQPENNYKTTPPVLDSDGSFFLYSKLTVDKSRWQQGNVF<br>SCSVMHEALHNHYTQKSLSLSPGK |
| SEQ ID NO: 95 - scFv<br>fragment humanized<br>SP34 VH1-VL27 -<br>human IgG1 Fc fusion | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSWFAYWGQGTTVT<br>VSSGGGGSGGGGSGGGGSEIVVTQSPATLSVSPGERATLSCRS<br>STGAVTTSAAANWVQEKPGQAFRGLIGGANKRAPGVPARFS<br>GSLSGDEATLTISSLQSEDFAVYYCALWYSNLWVFGQGTKLE<br>IKGGGGTDKTHTCPPCPAPELLGGPSVFLFPPKPKDTLMISRTP<br>EVTCVVVDVSHEDPEVKFNWYVDGVEVHNAKTKPREEQYN<br>STYRVVSVLTVLHQDWLNGKEYKCKVSNKALPAPIEKTISKA<br>KGQPREPQVYTLPPSRDELTKNQVSLTCLVKGFYPSDIAVEW<br>ESNGQPENNYKTTPPVLDSDGSFFLYSKLTVDKSRWQQGNVF<br>SCSVMHEALHNHYTQKSLSLSPGK |
| SEQ ID NO: 96 - scFv<br>fragment humanized<br>SP34 VH1-VL28 -<br>human IgG1 Fc fusion | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSWFAYWGQGTTVT<br>VSSGGGGSGGGGSGGGGSEIVVFQSPATLSVSPGERATLSCRS<br>STGAVTTSNYANWVQEKPGQAFRGLIGGAAARAPGVPARFS<br>GSLSGDEATLTISSLQSEDFAVYYCALWYSNLWVFGQGTKLE<br>IKGGGGTDKTHTCPPCPAPELLGGPSVFLFPPKPKDTLMISRTP<br>EVTCVVVDVSHEDPEVKFNWYVDGVEVHNAKTKPREEQYN<br>STYRVVSVLTVLHQDWLNGKEYKCKVSNKALPAPIEKTISKA<br>KGQPREPQVYTLPPSRDELTKNQVSLTCLVKGFYPSDIAVEW<br>ESNGQPENNYKTTPPVLDSDGSFFLYSKLTVDKSRWQQGNVF<br>SCSVMHEALHNHYTQKSLSLSPGK |
| SEQ ID NO: 97 - scFv<br>fragment humanized<br>SP34 VH1-VL29 -<br>human IgG1 Fc fusion | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSWFAYWGQGTTVT<br>VSSGGGGSGGGGSGGGGSEIVVTQSPATLSVSPGERATLSCRS<br>STGAVTTSNYANWVQEKPGQAFRGLIGGANKAAAGVPARFS<br>GSLSGDEATLTISSLQSEDFAVYYCALWYSNLWVFGQGTKLE<br>IKGGGGTDKTHTCPPCPAPELLGGPSVFLFPPKPKDTLMISRTP<br>EVTCVVVDVSHEDPEVKFNWYVDGVEVHNAKTKPREEQYN<br>STYRVVSVLTVLHQDWLNGKEYKCKVSNKALPAPIEKTISKA<br>KGQPREPQVYTLPPSRDELTKNQVSLTCLVKGFYPSDIAVEW<br>ESNGQPENNYKTTPPVLDSDGSFFLYSKLTVDKSRWQQGNVF<br>SCSVMHEALHNHYTQKSLSLSPGK |
| SEQ ID NO: 98 - scFv<br>fragment humanized<br>SP34 VH1-VL30 -<br>human IgG1 Fc fusion | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSWFAYWGQGTTVT<br>VSSGGGGSGGGGSGGGGSEIVVTQSPATLSVSPGERATLSCRS<br>STGAVTTSNYANWVQEKPGQAFRGLIGGANKRAPGVPARFS<br>GSLSGDEATLTISSLQSEDFAVYYCALWAANLWVFGQGTKLE<br>IKGGGGTDKTHTCPPCPAPELLGGPSVFLFPPKPKDTLMISRTP |

| | |
|---|---|
| | EVTCVVVDVSHEDPEVKFNWYVDGVEVHNAKTKPREEQYN<br>STYRVVSVLTVLHQDWLNGKEYKCKVSNKALPAPIEKTISKA<br>KGQPREPQVYTLPPSRDELTKNQVSLTCLVKGFYPSDIAVEW<br>ESNGQPENNYKTTPPVLDSDGSFFLYSKLTVDKSRWQQGNVF<br>SCSVMHEALHNHYTQKSLSLSPGK |
| SEQ ID NO: 99 - scFv<br>fragment humanized<br>SP34 VH1-VL31 -<br>human IgG1 Fc fusion | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSWFAYWGQGTTVT<br>VSSGGGGSGGGGSGGGGSEIVVTQSPATLSVSPGERATLSCRS<br>STGAVTTSNYANWVQEKPGQAFRGLIGGANKRAPGVPARFS<br>GSLSGDEATLTISSLQSEDFAVYYCALWYSALWVFGQGTKLE<br>IKGGGGTDKTHTCPPCPAPELLGGPSVFLFPPKPKDTLMISRTP<br>EVTCVVVDVSHEDPEVKFNWYVDGVEVHNAKTKPREEQYN<br>STYRVVSVLTVLHQDWLNGKEYKCKVSNKALPAPIEKTISKA<br>KGQPREPQVYTLPPSRDELTKINQVSLTCLVKGFYPSDIAVEW<br>ESNGQPENNYKTTPPVLDSDGSFFLYSKLTVDKSRWQQGNVF<br>SCSVMHEALHNHYTQKSLSLSPGK |
| SEQ ID NO: 100 - scFv<br>fragment humanized<br>SP34 VH5-VL32 -<br>human IgG1 Fc fusion | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSYFAYWGQGTTVT<br>VSSGGGGSGGGGSGGGGSEIVVTQSPATLSVSPGERATLSCRS<br>STGAVTAANYANWVQEKPGQAFRGLIGGANKRAPGVPARFS<br>GSLSGDEATLTISSIQSEDFAVYYCALFYSNLWVFGQGTKLEI<br>KGGGGTDKTHTCPPCPAPELLGGPSVFLFPPKPKDTLMISRTP<br>EVTCVVVDVSHEDPEVKFNWYVDGVEVHNAKTKPREEQYN<br>STYRVVSVLTVLHQDWLNGKEYKCKVSNKALPAPIEKTISKA<br>KGQPREPQVYTLPPSRDELTKNQVSLTCLVKGFYPSDIAVEW<br>ESNGQPENNYKTTPPVLDSDGSFFLYSKLTVDKSRWQQGNVF<br>SCSVMHEALHNHYTQKSLSLSPGK |
| SEQ ID NO: 101 - SP34<br>humanized VH1 domain | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSWFAYWGQGTTTVT<br>VSS |
| SEQ ID NO: 102 - SP34<br>humanized VH2 domain | EVQLVESGGGLVQPGGSLRLSCAASGFTFNTYAMNWVRQAP<br>GKGLEWVARIRSKYNNYATYYADSVKSRFTISRDDSKNTLYL<br>QMNSLRAEDTAVYYCVRHGNFGNSYVSWFAYWGQGTTVTV<br>SS |
| SEQ ID NO: 103 - SP34<br>humanized VH3 domain | EVQLVESGGGLVQPGGSLRLSCAASGFTFNTYAMNWVRQAP<br>GKGLEWVARIRSKYNNYATYYADSVKSRFTISRDDSKNTLYL<br>QMNSLRAEDTAVYYCVRHGNFGNSYVSYFAYWGQGTTVV<br>SS |
| SEQ ID NO: 104 - SP34<br>humanized VH5 domain | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSYFAYWGQGTTVT<br>VSS |
| SEQ ID NO: 105 - SP34<br>humanized VL21<br>domain | EIVVTQSPATLSVSPGERATLSCRSSTGAVTTSNYANWVQEKP<br>GQAFRGLIGGANKRAPGVPARFSGSLSGDEATLTISSLQSEDF<br>AVYYCALWYSNLWVFGQGTKLELK |
| SEQ ID NO: 106 - SP34<br>humanized VL32<br>domain | EIVVTQSPATLSVSPGERATLSCRSSTGAVTAANYANWVQEK<br>PGQAFRGLIGGANKRAPGVPARFSGSLSGDEATLTISSLQSED<br>FAVYYCALFYSNLWVFGQGTKLEIK |
| SEQ ID NO: 107 -<br>Humanized anti-HER2<br>antibody 4D5 - scFv<br>fragment | EVQLVESGGGLVQPGGSLRLSCAASGFNIKDTYIHWYRQAPG<br>KGLEWVARIYPTNGYTRYADSVKGRFTISADTSKNTAYLQM<br>NSLRAEDTAVYYCSRWGGDGFYAMDYWGQGTLVTVSSGGG<br>GSGGGGSGGGGSDIQMTQSPSSLSASVGDRVTITCRASQDVN<br>TAVAWYQQKPGKAPKLLIYSASFLYSGVPSRFSGSRSGTDFTL<br>TISSLQPEDFATYYCQQHYTTPPTFGQGTKVEIK |
| SEQ ID NO: 108 -<br>Humanized anti-HER2<br>antibody 4D5 - FAB<br>fragment heavy chain<br>(VH-VH1)with<br>VH: G65S substitution | EVQLVESGGGLVQPGGSLRLSCAASGFNIKDTYIHWVRQAPG<br>KGLEWVARIYPTNGYTRYADSVKSRFTISADTSKNTAYLQMN<br>SLRAEDTAVYYCSRWGGDGFYAMDYWGQGTLVTVSS |
| SEQ ID NO: 109 -<br>Humanized anti-HER2<br>antibody 4D5 - scFv | EVQLVESGGGLVQPGGSLRLSCAASGFNIKDTVIHWVRQAPG<br>KGLEWVARIYPTNGYTRYADSVKSRFTISADTSKNTAYLQMN<br>SLRAEDTAVYYCSRWGGDGFYAMDYWGQGTLVTVSSGGGG |

Sequence listing

| | |
|---|---|
| fragment with VH: G65S substitution | SGGGGSGGGGSDIQMTQSPSSLSASVGDRVTITCRASQDVNT AVAWYQQKPGKAPKLLIYSASFLYSGVPSRESGSRSGTDFTLT ISSLQPEDFATYYCQQHYTTPPTFGQGTKVEIK |
| SEQ ID NO: 110 - Humanized anti-HER2 antibody 4D5 - FAB fragment heavy chain (VH-VH1) with VH: N82aS substitution | EVQLVESGGGLVQPGGSLRLSCAASGFNIKDTYIHWVRQAPG KGLEWVARIYPTNGYTRYADSVKGRFTISADTSKNTAYLQMS SLRAEDTAVYYCSRWGGDGFYAMDYWGQGTLVTVSS |
| SEQ ID NO: 111 - Humanized anti-HER2 antibody 4D5 - scFv fragment with V14: N82aS substitution | EVQLVESGGGLVQPGGSLRLSCAASGFNIKDTVIHWVRQAPG KGLEWVARIYPTNGYTRYADSVKGRFTISADTSKNTAYLQMS SLRAEDTAVYYCSRWGGDGFYAMDYWGQGTLVTVSSGGGG SGGGGSGGGGSDIQMTQSPSSLSASVGDRVTITCRASQDVNT AVAWYQQKPGKAPKLLIYSASFLYSGVPSRFSGSRSGTDFTLT ISSLQPEDFATYYCQQHYTTPPTFGQGTKVEIK |
| SEQ ID NO: 112 - OKT10 mouse VH domain | QVELVESGGSLKLSCAASGFDFSRSWMNWVRQAPGKGLEWI GEINPDSSTINYTTSLKDKFIISRDNAKNTLYLQMTKVRSEDTA LYYCARYGNWFPYWGQGTLVTVSS |
| SEQ ID NO: 113 - OKT10 mouse VL domain | DILMIQSQKIMPTSVGDRVSVTCKASQNVDTNVAWYQQKPG QSPKALIYSASYRYSGVPDRFTGSGSGTDFTLTITNVQSEDLA EYFCQQYDSYPLTFGAGTKLDLKR |
| SEQ ID NO: 114 - HB-7 mouse VH domain | KVQLQESGPSLVQPSQRLSITCTVSGFSLISYGVHWVRQSPGK GLEWLGVIWRGGSTDYNAAFMSRLSITKDNSKSQVFFKMNS LQADDTAIYFCAKTLITTGYAMDYWGQGTTVTVSS |
| SEQ ID NO: 115 - HB-7 mouse VL domain | DIELTQSPSSFSVSLGDRVTITCKASEDIYNRLAWYQQKPGNA PRLLISGATSLETGVPSRFSGSGSGKDYTLSITSLQTEDVATYY CQQYWSTPTFGGGTKLEIK |
| SEQ -ID NO: 116 - Humanized HB-7 best-fit VH domain | QVQLQESGPGLVKPSETLSLTCTVSGFSLISYGVHWVRQPPGK GLEWLGVIWRGGSTDYNAAFMSRLTISKDNSKNQVSLKLSSV TAADTAVYFCAKTLITTGYAMDYWGQGTLVTVSS |
| SEQ ID NO: 117 - Humanized HB-7 best-fit VL domain | DIQLTQSPSSLSASVGDRVTITCRASEDIYNRLAWYQQKPGKA PKLLISGATSLETGVPSRFSGSGSGKDYTLTISSLQPEDFATYY CQQYWSTPTFGQGTKLEIK |
| SEQ ID NO: 118 - Humanized HB-7 best-fit heavy chain | QVQLQESGPGLVKPSETLSLTCTVSGFSLISYGVHWVRQPPGK GLEWLGVIWRGGSTDYNAAFMSRLTISKDNSKNQVSLKLSSV TAADTAVYFCAKTLITTGYAMDYWGQGTLVTVSSASTKGPS VFPLAPSSKSTSGGTAALGCLVKDYFPEPVTVSWNSGALTSG VFPLAVLQSSGLYSLSSVVTVPSSSLGTQTYICNVNHKPSNT KVDKKVEPKSCDKTHTCPPCPAPELLGGPSVFLFPPKPKDTLM ISRTPEVTCVVVDVSHEDPEVKFNWNYVDGVEVHNAKTKPRE EQYNSTYRVVSVLTVLHQDWLNGKEYKCKVSNKALPAPIEK TISKAKGQPREPQVYTLPPSRDELTKNQVSLTCLVKGFYPSDI AVEWESNGQPENNYKTTPPVLDSDGSFFLYSKLTVDKSRWQ QGNVFSCSVMHEALHNHYTQKSLSLSPGK |
| SEQ ID NO: 119 - Humanized HB-7 best-fit light chain | DIQLTQSPSSLSASVGDRVTITCRASEDIYNRLAWYQQKPGKA PKLLISGATSLETGVPSRFSGSGSGKDYTLTISSLQPEDFATYY CQQYWSTPTFGQGTKLEIKRTVAAPSVFIFPPSDEQLKSGTAS VVCLLNNFYPREAKVQWKVDNALQSGNSQESVFEQDSKDST YSLSSTLTLSKADYEKHKVYACEVTHQGLSSPVTKSFNRGEC |
| SEQ ID NO: 120 - Chimeric HB-7 heavy chain IgG1 | KVQLQESGPSLVQPSQRLSITCTVSGFSLISYGVHWVRQSPGK GLEWLGVIWRGGSTDYNAAFMSRLSITKDNSKSQVFFKMNS LQADDTAIYFCAKTLITTGYAMDYWGQGTTVTCSSASTKGPS VFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPELLGGPSVFLFPPKPKDTLM ISRTPEVTCVVVDVSHEDPEVKFNWYVDGVEVHNAKTKPRE EQYNSTYRVVSVLTVLHQDWLNGKEYKCKVSNKALPAPIEK TISKAKGQPREPQVYTLPPSRDELTKNQVSLTCLVKGFYPSDI AVEWESNGQPENNYKTTPPVLDSDGSFFLYSKLTVDKSRWQ QGNVFSCSVMHEALHNHYTQKSLSLSPGK |
| SEQ ID NO: 121 - Chimeric HB-7 human kappa light chain | DIELTQSPSSFSVSLGDRVTITCKASEDIYNRLAWYQQKPGNA PRLLISGATSLETGVPSRFSGSGSGKDYTLSITSLQTEDVATYY CQQYWSTPTFGGGTKLEIKRTVAAPSVFIFPPSDEQLKSGTAS VVCLLNNFYPREAKVQWKVDNALQSGNSQESVTEQDSKDST YSLSSTLTLSKADYEKHKVYACEVTHQGLSSPVTKSFNRGEC |

| Sequence listing | |
|---|---|
| SEQ ID NO: 122 - 9G7 mouse VH domain | QVTLKESGPGILQPSQTLSLTCSFSGLSLSTSGKGVGWIRQPSG KGLEWLAHIWWDDDKRYNPALKSRLTISKDTSSNQVFLKIAS VDTADTATYYCARIELGRSYVMDYWGQGTTVTVSS~ |
| SEQ ID NO: 123 - 9G7 mouse VL domain | DIVMTQSHKFMSTSVGDRVSISCKASQDVITSVAWFQQKPGQ SPKLLIYSASYRYTGVPDRFTGSGSGTDFTFTISSVQAEDLAVY YCQQHYTIPLTFGAGTKLELK |
| SEQ ID NO: 124 - Humanized 9G7 best-fit heavy chain | QVTLKESGPTLVKPTQTLTLTCTFSGLSLSTSGKGVGWIRQPP GKALEWLAHIWWDDDKRYNPALKSRLTITKDTSKNQVVLT MTNMDPVDTATYYCARIELGRSYVMDYWGQGTLVTVSSAS TKGPSVFPLAPSSKSTSGGTAALGCLVKDYFPEPVTVSWNSG ALTSGVHTFPAVLQSSGLYSLSSVVTVPSSSLGTQTYICNVNH KPSNTKVDKKVEPKSCDKTHTCPPCPAPELLGGPSVFLFPPKP KDTLMISRTPEVTCVVVDVSEIEDPEVKFNWYVDGVEVHNAK TKPREEQYNSTYRVVSVLTVLHQDWLNGKEYKCKVSNKALP APIEKTISKAKGQPREPQVYTLPPSRDELTKNQVSLTCLVKGF YPSDIAVEWESNGQPENNYKTTPPVLDSDGSFFLYSKLTVDKS RWQQGNVFSCSVMHEALHNHYTQKSLSLSPGK~ |
| SEQ ID NO: 125 - Humanized 9G7 best-fit first prototype light chain | DIQMTQSPSSLSASVGDRVTITCQASQDVITSVAWFQQKPGK APKLLIYSASYRYTGVPSRFSGSGSGTDFTFTISSLQPEDIATYY CQQHYTIPLTFGQGTKLEIKRTVAAPSVFIFPPSDEQLKSGTAS VVCLLNNFYPREAKVQWKVDNALQSGNSQESVTEQDSKDST YSLSSTLTLSKADYEKHKVYACEVTHQGLSSPVTKSFNRGEC |
| SEQ ID NO: 126 - Chimeric 9G7 heavy chain IgG1 | QVTLKESGPGILQPSQTLSLTCSFSGLSLSTSGKGVGWIRQPSG KGLEWLAHIWWDDDKRYNPALKSRLTISKDTSSNQVFLKIAS VDTADTATYYCARIELGRSYVMDYWGQGTTVTVSSASTKGP SVFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPELLGGPSVFLFPPKPKDTLM ISRTPEVTCVVVDVSHEDPEVKFNWYVDGVEVHNAKTKPRE EQYNSTYRVVSVLTVLHQDWLNGKEYKCKVSNKALPAPIEK TISKAKGQPREPQVYTLPPSRDELTKNQVSLTCLVKGFYPSDI AVEWESNGQPENNYKTTPPVLDSDGSFFLYSKLTVDKSRWQ QGNVFSCSVMHEALHNHYTQKSLSLSPGK |
| SEQ ID NO: 127 - Chimeric 9G7 human kappa light chain | DIVMTQSHKFMSTSVGDRYSISCKASQDVITSVAWFQQKPGQ SPKLLIYSASYRYTGVPDRFTGSGSGTDFTFTISSVQAEDLAVY YCQQHYTIPLTFGAGTKLELKRTVAAPSVFIFPPSDEQLKSGT ASVVCLLNNFYPREAKVQWKVDNALQSGNSQESVTEQDSKD STYSLSSTLTLSKADYEKHKVYACEVTHQGLSSPVTKSFNRG EC |
| SEQ ID NO: 128 - Humanized 9G7 hest-fit light chain (prototype light chain with F36Y substitution) | DIQMTQSPSSLSASVGDRVTITCQASQDVITSVAWYQQKPGK APKLLIYSASYRYTGVPSRFSGSGSGTDFTFTISSLQPEDIATYY CQQHYTIPLTFGQGTKLEIKRTVAAPSVFIFPPSDEQLKSGTAS VVCLLNNFYPREAKVQWKVDNALQSGNSQESVTEQDSKDST YSLSSTLTLSKADYEKHKVYACEVTHQGLSSPVTKSFNRGEC |
| SEQ ID NO: 129 - Humanized 9G7 best-fit VH domain | QVTLKESGPTLVKPTQTLTLTCTFSGLSLSTSGKGVGWIRQPP GKALEWLAHIWWDDDKRYNPALKSRLTITKDTSKNQVVLT MTNMDPVDTATYYCARIELGRSYVMDYWGQGTLVTVSS |
| SEQ ID NO: 130 - Humanized 9G7 hest-fit VL domain | DIQMTQSPSSLSASVGDRVITIVQASQDVITSVAWFQQKPGK APKLLIYSASYRFSGSGSGTDFTFTISSLQPEDIATYY CQQHYTIPLTFGQGTKLEIK |
| SEQ ID NO: 131 - Humanized 9G7 best-framework heavy chain | EVQLVESGGGLVQPGGSLRLSCAFSGLSLSTSGKGVGWIRQA PGKGLEWLAHIW~WDDDKRYNPALKSRLTISKDTSKNTVYIL QMNSLRAEDTAVYYCARIELGRSYVMDYWGQGTLVTVSSAS TKGPSVFPLAPSSKSTSGGTAALGCLVKDYFPEPVTVSWNSG ALTSGVHTFPAVLQSSGLYSLSSVVTVPSSSLGTQTYICNVNH KPSNTKVDKKVEPKSCDKTHTCPPCPAPELLGGPSVFLFPPKP KDTLMISRTPEVTCVVVDVSHEDPEVKFNWYVDGVEVHNAK TKPREEQYNSTYRVVSVLTVLHQDWLNGKEYKCKVSNKALP APIEKTISKGQPREPQVYTLPPSRDELTKNQVSLTCLVKGF YPSDIAVEWESNGQPENNYKTTPPVLDSDGSFFLYSKLTVDKS RWQQGNVFSCSVMHEALHNHYTQKSLSLSPGK |
| SEQ ID NO: 132 - Humanized 9G7 best-framework light chain | DIQMTQSPSSLSASVGDRVTITCRASQDVITSVAWFQQKPGKA PKLLIYSASYRFSGSGSGTDFTLTISSLQPEDFATYY CQQHYTIPLTFGQGTKVEIKRTVAAPSVFIFPPSDEQLKSKDST VVCLLNNFYPREAKVQWKVDNALQSGNSQESVTEQDSKDST YSLSSTLTLSKADYEKHKVYACEVTHQGLSSPVTKSFNRGEC |

| Sequence listing | |
|---|---|
| SEQ ID NO: 133 - Humanized 9G7 best-framework VH domain | EVQLVESGGGLVQPGGSLRLSCAFSGLSLSTSGKGVGWIRQA PGKGLEWLAHIW~WDDDKRYNPALKSRLTISKDTSKNTVYL QMNSLRAEDTAVYYCARIELGRSYVMDYWGQGTLVTVSS |
| SEQ ID NO: 134 - Humanized 9G7 best-framework VL domain | DIQMTQSPSSLSASVGDRVTITCRASQDVITSVAWFQQKPGKA PKLLIYSASYRYTGVPSRFSGSGSGTDFTLTISSLQPEDFATYY CQQHYTIPLTFGQGTKVEIK |
| SEQ ID NO: 135 - Human clone 767 VH domain | QVQLVESGGGLVQPGGSLRLSCAASGFTFSSYWMSWVRQAP GKGLEWVANIKQDGSEKYYVDSVKGRFTISRDNAKNSLYLQ MNSLRAEDTAVYYCAREGRTGYFDYWGQGTLVTVSS |
| SEQ ID NO: 136 - Human clone 767 VL domain | QSVLTQPPSASGTPGQRVTISCSGSTSNIGTNYVYWYQQLPGT APKLLIYRNDQRPSGVPDRFSGSKSGTSASLAISGLRSEDEAD YYCAAWDDSRSGVYAFGTGTKVTVL |
| SEQ ID NO: 137 - Human 767 heavy chain | QVQLVESGGGLVQPGGSLRLSCAASGFTSSYWMSWVRQAP GKGLEWVANIKQDGSEKYYVDSVKGRFTISRDNAKNSLYLQ MNSLRAEDTAVYYCAREGRTGYFDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKVDKKVEPKSCDKTHTCPPCPAPELLGGPSVFLFPPKPKDT LMISRTPEVTCVVVDVSHEDPEVKFNWYVDGVEVHNAKTKP REEQYNSTYRVVSVLTVLHQDWLNGKEYKCKVSNKALPAPI EKTISKAKGQPREPQVYTLPPSRDELTKNQVSLTCLVKGFYPS DIAVEWESNGQPENNYKTTPPVLDSDGSFFLYSKLTVDKSRW QQGNVFSCSVMHEALHNHYTQKSLSLSPGK |
| SEQ ID NO: 138 - Human 767 light chain | QSVLTQPPSASGTPGQRVTISCSGSTSNIGTNYVYWYQQLPGT APKLLIYRNDQRPSGVPDRFSGSKSGTSASLAISGLRSEDEAD YYCAAWDDSRSGVYAFGTGTKVTVLRTVAAPSVFIFPPSDEQ LKSGTASVVCLLNNFYPREAKVQWKVDNALQSGNSQESVTE QDSKDSTYSLSSTLTLSKADYEKHKVYACEVTHQGLSSPVTK SFNRGEC |
| SEQ ID NO: 139 - Mouse anti-human OX40 antibody VH domain from WO2013/0081711 | QVTLKESGPGILQPSQTLSLTCSFSGFSLSTSGMGVGWIRQPSG KGLEWLAHIWWDDDKYYNTALKSGLTISKDTSKNQVFLKIA SVDTTDTATYYCARIDWDGFAYWGQGTLVTVSS |
| SEQ ID NO: 140 - Mouse anti-human OX40 antibody VL domain from WO2013/008171 | QIVLTQSPAILSASPGEKVTMTCRASSSVSYMHWYQQKPGSSP KPWIYATSNLASGVPARFSGSGSGTSYSLTINRVEAEDAATYY CQQWSSNPWTFGGGTKLEIK |
| SEQ ID NO: 141 - Humanized anti-human OX40 antibody VH domain from WO2013/008171 | QVTLKESGPALVKPTQTLTLTCSFSGFSLSTSGMGVGWIRQPP GKALEWIAHIWWDDDKYYNTALKTRLTISKIDTSKNQVVLTM TNMDPVDTATYYCARIDWDGFAYWGQGTLVTVSS |
| SEQ ID NO: 142 - Humanized anti-human OX40 antibody VL domain from WO2013/008171 | EIVLTQSPATLSLSPGERATLSCRASSSVSYMHWYQQKPGQAP RPWIYATSNRATGIPARFSGSGSGTDYTLTISSLEPEDFAVYYC QQWSSNPWTFGQGTKVEIK |
| SEQ ID NO: 143 - rituximab mouse VH domain | QVQLQQPGAELVKPGASVKMSCKASGYTFTSYNMHWVKQT PGRGLEWIGAIYPGNGDTSYNQKFKGKATLTADKSSSTAYM QLSSLTSEDSAVYYCARSTYYGGDWYFNVWGAGTTVTVSA |
| SEQ ID NO: 144 - rituximab mouse VL domain | QIVLSQSPAILSASPGEKVTMETTCRASSSVSYIHWFQQKPGSS PKPWIYATSNLASGVPVRFSGSGSGTSYSLTISRVEAEDAATY YCQQWTSNPPTFGGGTKLELK |
| SEQ ID NO: 145 - cetuximab mouse VH domain | QVQLKQSGPGLVQPSQSLSITCTVSGFSLTNYGVHWVRQSPG KGLEWLGVIWSGGNTDYNTPFTSRLSINKDNSKSQVFFKMNS LQSNDTAIYYCARALTYYDYEFAYWGQGTLVTVSA |
| SEQ ID NO: 146 - cetuximab mouse VL domain | DILLTQSPVILSVSPGERVSFSCRASQSIGTNIHWYQQRTNGSP RLLIKYASESISGIPSRFSGSGSGTDFTLSINSVESEDIADYYCQ QNNNWPTTFGAGTKLELK |

| Sequence listing | |
|---|---|
| SEQ ID NO: 147 - BTA CH3 NO: 1 Original BTA 11 | GQPREPQVYTLPPSRDELTKNQVKLVCLVTGFYPSDIAVEWE SNGQPENNYYTTPPVLDSDGSFSLVSWLNVDKSRWQQGNVF SCSVMHEALHNHYTQKSLSLSPGK~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~ |
| SEQ ID NO: 148 - BTA CH3 NO: 2 BTA FTO 11 | GQPREPAVYTLPPSRDELTKNQVKLVCLVTGFYPSDIAVEWE SNGQPENNYYTTPPVLDSDGSFSLVSWLNVDKSRWQQGNVF SCSVMHEALHNHYTQRSLSLSPGK~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~ |
| SEQ ID NO: 149 - BTA CH3 NO: 3 BTA FTO 33 411D | GQPREPAVYTLPPSREEMTKNQVKLVCLVTGFYPSDIAVEWE SSGQPENNYYTTPPVLDSDGSFSLVSWLNVDKSRWQQGNVS SCSVMHEALHNHYTQKSLSLSPGK~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~ |
| SEQ ID NO: 150 - BTB CH3 NO: 1 Original BTB | GQPREPEVATFPPSRDELTKNQVTLVCLVTGFYPSDIAVEWES NGQPENNYKTDPPLLESDGSFALSSRLRVDKSRWQQGNVFSC SVMHEALHNHYTQKSLSLSPGK~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~ |
| SEQ ID NO: 151 - BTB CH3 NO: 2 BTB 401R 11 | GQPREPEVATFPPSRDELTKNQVTLVCLVTGFYPSDIAVEWES NGQPENNYKTDPPLLESRGSFALSSRLRVDKSRWQQGNVFSC SVMHEALHNHYTQKSLSLSPGK~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~ |
| SEQ ID NO: 152 - BTB CH3 No 3 BTB 401Q 11 | GQPREPEVATFPPSRDELTKNQVTLVCLVTGFYPSDIAVEWES NGQPENNYKTDPPLLESQGSFALSSRLRVDKSRWQQGNVFSC SVMHEALHNHYTQKSLSLSPGK~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~~~~ ~~~~~~~~~~~~~~~~~~~~~~~~~~~~~~~~~~~~~~ |
| SEQ ID NO: 153 - BTA CH3 NO: 4 BTA 11 FTO_N411T | GQPREPAVYTLPPSRDELTKNQVKLVCLVTGFYPSDIAVEWE SNGQPENNYYTTPPVLDSDGSFSLVSWLTVDKSRWQQGNVF SCSVMHEALHNHYTQKSLSLSPGK |
| SEQ ID NO: 154 - BTA CH3 NO: 5 BTA 33_FTO | GQPREPAVYTLPPSREEMTKNQVKLVCLVTGFYPSDIAVEWE SSGQPENNYYTTPPMLDSDGSFSLVSWLNVDKSRWQQGNIFS CSVMHEALHNRFTQKSLSLSPGK |
| SEQ ID NO: 155 - BTA CH3 NO: 6 BTA 33_FTO_N411T | GQPREPAVYTLPPSREEMTKNQVKLVCLVTGFYPSDIAVEWE SSGQPENNYYTTPPMLDSDGSFSLVSWLTVDKSRWQQGNIFS CSVMHEALHNRETQKSLSLSPGK |
| SEQ ID NO: 156 - BTB CH3 No: 4 BTB 33_D401Q | GQPREPEVATFPPSREEMTKNQVTLVCLVTGFYPSDIAVEWES SGQPENNYNTDPPLLESQGSFALSSRLRVDKSRWQQGNIFSCS VMHEALHNRFTQKSLSLSPGK |
| SEQ ID NO: 157 - BTB CH3 No: 5 BTB 11_D401Q_R411T | GQPREPEVATFPPSRDELTKNQVTLVCLVTGFYPSDIAVEWES NGQPENNYKTDPPLLESQGSFALSSRLTVDKSRWQQGNVFSC SVMHEALHNHYTQKSLSLSPGK |
| SEQ ID NO: 158 - BTB CH3 No 6 BIB 33_D401Q_R411T | GQPREPEVATFPPSREEMTFKNQVTLVCLVTGFYPSDIAVEWES SGQPENNYNTDPPLLESQGSFALSSRLTVDKSRWQQGNIFSCS VMHEALHNRFTQKSLSLSPGK |
| SEQ ID NO: 159 - BEAT HER2/CD3-1 antibody FAB heavy chain (CD3 epsilon arm - humanized OKT3 with N82aS substitution) | EVQLVESGGGLVQPGGSLRLSCAASGYTFTRYTMHWVRQAP GKGLEWIGYINPSRGYTYYADSVKGRFTLSTDKSKNTAYLQ MSSLRAEDTAVYYCARYYDDHYCLDYWGQGTLVTVSSAST KGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPEAAGGPSVFLFPPKPK DTLMISRTPEVTCVVVDVSHEDPEVQFKWYVDGVEVHNAKT KPREEQYNSTFRVVSVLTVLHQDWLNGKEYKCKVSNKALPA |

| | |
|---|---|
| | PIEKTISKTKGQPREPAVYTLPPSREEMTKNQVKLVCLVTGFY<br>PSDIAVEWESSGQPENNYYTTPPMLDSDGSFSLVSWLNVDKS<br>RWQQGNIFSCSVMHEALHNRFTQKSLSLSPGK |
| SEQ ID NO: 160 -<br>BEAT HER2/CD3-1<br>antibody scFv heavy<br>chain (HER2 arm) | EVQLVESGGGKVQPGGSLRLSCAASGFNIKDTYIHWVRQAPG<br>KGLEWVARIYPTNGYTRYADSVKGRFTISADTSKNTAYLQM<br>NSLRAEDTAVYYCSRWGGDGFYAMDYWGQGTLVTVSSGGG<br>GSGGGGSGGGGSDIQMTQSPSSLSASVGDRYTITCRASQDVN<br>TAVAWYQQKPGKAPKLLIYSASFLYSGVPSRFSGSRSGTDFTL<br>TISSLQPEDFATYYCQQHYTTPPTFGQGTKVEIKRGGGGTDKT<br>HTCPPCPAPEAAGGPSVFLFPPKPKDTLMISRTPEVTCVVVDV<br>SHEDPENKFNWYVDGVEVHNAKTKPREEQYNSTYRVVSVLT<br>VLHQDWLNGKEYKCKVSNKALPAPIEKTISKAKGQPREPEVA<br>TFPPSRDELTKNQVTLVCLVTGFYPSDIAVEWESNGQPENNY<br>KTDPPLLESDGSFALSSRLRVDKSRWQQGNVFSCSVMHEALH<br>NHYTQKSLSLSPGK |
| SEQ ID NO: 161 -<br>BEAT HER2/CD3-2<br>antibody FAB heavy<br>chain (HER2 arm) | EVQLVESGGGLVQPGGSLRLSCAASGFNIKDTYIHWVRQAPG<br>KGLEWVARIYPTNGYTRYADSVKGRFTISADTSKNTAYLQM<br>NSLRAEDTAVYYCSRWGGDGFYAMDYWGQGTLVTVSSAST<br>NGPSVFPLAPSSKSTSGGTAALGCLVKDYFPEPVTVSWNSGA<br>LTSGVHTFPAVLQSSGLYSLSSVVTVPSSSLGTQTYICNVNHK<br>PSNTKVDKKVEPKSCDKTHTCPPCPAPEAAGGPSVFLFPPKPK<br>DTLMISRTPEVTCVVVDVSHEDPEVKFNWYVDGVEVHNAKT<br>KPREEQYNSTYRVVSVLTVLHQDWLNGKEYKCKVSNKALPA<br>PIEKTISKAKGQPREPAVYTLPPSRDELTKNQVKLVCLVTGFY<br>PSDIAVEWESNGQPENNYYTTPPVLDSDGSFSLVSWLNVDKS<br>RWQQGNVFSCSVMHEALHNHYTQKSLSLSPGK |
| SEQ ID NO: 162 -<br>BEAT HER2/CD3-2<br>antibody scFv heavy<br>chain (CD3 epsilon arm -<br>humanized OKT3 with<br>N82aS substitution) | EVQLVESGGGLVQPGGSLRLSCAASGYTFTRYTMHWVRQAP<br>GKGLEWIGYINPSRGYTYYADSVKGRFTLSTDKSKNTAYLQ<br>MSSLRAEDTAVYYCARYYDDHYCLDYWGQGTLVTVSSGGG<br>GSGGGGSGGGGSGGGASDIQLTQSPSSLSASVGDRVTITCRAS<br>SSVSYVAWYQQKPGKAPKRWIYDTSKLYSGVPSRFSGSGSGT<br>DYTLTISSLQPEDFATYYCQQWSSNPPTFGQGTKVEIKGGGGT<br>DKTHTCPPCPAPEAAGGPSVFLFPPKPKDTLMISRTPEVTCVV<br>VDVSHEDPEVQFKWYVDGVEVHNAKTKPREEQYNSTFRVVS<br>VLTVLHQDWLNGKEYKCKVSNKALPAPIEKTISKTKGQPREP<br>EVATFPPSREEMTKNQVTLVCLVTGFYPSDIAVEWESSGQPE<br>NNYNTDPPLLESDGSFALSSRLRVDKSRWQQGNIFSCSVMHE<br>ALHNRFTQKSLSLSPGK |
| SEQ ID NO: 163 -<br>BEAT HER2/CD3-3<br>antibody FAB heavy<br>chain(CD3 epsilon arm -<br>humanized OKT3 with<br>G65S substitution) | EVQLVESGGGLVQPGGSLRLSCAASGYTFTRYTMHWVRQAP<br>GKGLEWIGYINPSRGYTYYADSVKSRFTLSTDKSKNTAYLQM<br>NSLRAEDTAVYYCARYYDDHYCLDYWGQGTLVTVSSASTK<br>GPSVFPLAPSSKSTSGGTAALGCLVKDYFPEPVTVSWNSGALT<br>SGVHTFPAVLQSSGLYSLSSVVTVPSSSLGTQTYICNVNHKPS<br>NTKVDKKVEPKSCDKTHTCPPCPAPEAAGGPSVFLFPPKPKD<br>TLMISRTPEVTCVVVDVSHEDPEVQFKWYVDGVEVHNAKTK<br>PREEQYNSTFRVVSVLTVLHQDWLNGKEYKCKVSNKALPAPI<br>EKTISKTKGQPREPAVYTLPPSREEMTKNQVKLVCLVTGFYPS<br>DIAVEWESSGQPENNYYTTPPMLDSDGSFSLVSWLNVDKSR<br>WQQGNIFSCSVMHEALHNRFTQKSLSLSPGK |
| SEQ ID NO: 164 -<br>BEAT HER2/CD3-3<br>antibody scFv heavy<br>chain (HER2 arm with<br>additional disulfide<br>bond) | EVQLVESGGGLVQPGGSLRLSCAASGFNIKDTYIHWVRQAPG<br>KCLEWVARIYPTNGYTRYADSVKGRFTISADTSKNTAYLQM<br>NSLRAEDTAVYYCSRWGGDGFYAMDYWGQGTLVTVSSGGG<br>GSGGGGSGGGGSDIQMTQSPSSLSASVGDRVITFCRASQDVN<br>TAVAWYQQKPGKAPKLLIYSASFLYSGVPSRFSGSRSGTDFTL<br>TISSLQPEDFATYYCQQHYTTPPTFGCGTKVEIKGGGGTDKTH<br>TCPPCPAPEAAGGPSVFLFPPKPKDTLMISRTPEVTCVVVDVS<br>HEDPEVKFNWYVDGVEVHNAKTKPREEQYNSTYRVVSVLTV<br>LHQDWLNGKEYKCKVSNKALPAPIEKTISKAKGQPREPEVAT<br>FPPSRDELTKNQVTLVCLVTGFYPSDIAVEWESNGQPENNYK<br>TDPPLLESQGSFALSSRLRVDKSRWQQGNVFSCSVMHEALHN<br>HYTQKSLSLSPGK |
| SEQ ID NO: 165 -<br>BEAT<br>HER2/CD3(SP34)<br>antibody FAB heavy<br>chain(CD3 epsilon arm -<br>humanized SP34 VH<br>from WO2008/119565) | EVQLVESGGGLVQPGGSLKLSCAASGFTFNKYAMNWVRQAP<br>GKGLEWVARIRSKYNNYATYYADSVKDRFTISRDDSKNTAY<br>LQMNNLKTEDTAVYYCVRHGNFGNSYISYWAYWGQGTLVT<br>VSSASTKGPSVFPLAPSSKSTSGGTAALGCLVKDYFPEPVTVS<br>WNSGALTSGVHTFPAVLQSSGLYSILSSVVTVPSSSLGTQTYIC<br>NVNHKPSNTKVDKKVEPKSCDKTHTCPPCPAPEAAGGPSVFL<br>FPPKPKDTLMISRTPEVTCVVVDVSHEDPEVKFNWYVDGVEV<br>HNAKTKPREEQYNSTYRVVSVLTVLHQDWLNGKEYKCKVS |

| | |
|---|---|
| | NKALPAPIEKTISKAKGQPREPAVYTLPPSRDELTKNQVKLVC<br>LVTGFYPSDIAVEWESNGQPENNYYTTPPVLDSDGSFSLVSW<br>LNVDKSRWQQGNVFSCSVMHEALHNHYTQKSLSLSPGK |
| SEQ ID NO: 166 -<br>BEAT<br>HER2/CD3(SP34)<br>antibody FAB light<br>chain(CD3 epsilon arm -<br>humanized SP34 VL<br>from WO2008/119565) | QTVVTQEPSLTVSPGGTVTLTCGSSTGAVTSGNYPNWVQQKP<br>GQAPRGLIGGTKFLAPGTPARFSGSLLGGKAALTLSGVQPEDE<br>AEYYCVLWYSNRWVFGGGTKLTVLGRTVAAPSVFIFPPSDEQ<br>LKSGTASVVCLLNNFYPREAKVQWKVDNALQSGNSQESVTE<br>QDSKDSTYSLSSTLTLSKADYEKHKVYACEVTHQGLSSPVTK<br>SFNRGEC |
| SEQ ID NO: 167 -<br>BEAT<br>HER2/CD3(SP34)<br>antibody scfv heavy<br>chain (HER2 arm with<br>N82aS substitution) | EVQLVESGGGLVQPGGSLRLSCAASGFNIKDTYIHWVRQAPG<br>KGLEWVARIYPTNGYTRYADSVKGRFTISADTSKNTAYLQMS<br>SLRAEDTAVYYCSRWGGDGFYAMDYWGQGTLVTVSSGGGG<br>SGGGGSGGGGSDIQMTQSPSSLSASVGDRVTITCRASQDVNT<br>AVAWYQQKPGKAPKLLIYSASFLYSGVPSRFSGSRSGTDFTLT<br>ISSLQPEDFATYYCQQHYTTPPTFGQGTKVEIKGGGGTDKTHT<br>CPPCPAPEAAGGPSVFLFPPKPKDTLMISRTPEVTCVVVDVSH<br>EDPEVQFKWYVDGVEVHNAKTKPREEQYNSTFRVVSVLTVL<br>HQDWLNGKEYKCKVSNKALPAPIEKTISKTKGQPREPEVATF<br>PPSREEMTKNQVTLVCLVTGFYPSDIAVEWESSGQPENNYNT<br>DPPLLESQGSFALSSRLRVDKSRWQQGNIFSCSVMHEALHNR<br>FTQKSLSLSPGK |
| SEQ ID NO: 168 -<br>BEAT<br>HER2/CD3(SP34-<br>Kappa1) antibody FAB<br>heavy chain(CD3<br>epsilon arm - humanized<br>SP34 VH1) | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSWFAYWGQGTTVT<br>VSSASTKGPSVFPLAPSSKSTSGGTAALGCLVKDYFPEPVTVS<br>WNSGALTSGVHTFPAVLQSSGLYSLSSVVTVPSSSLGTQTYIC<br>NVNHKPSNTKVDKKVEPKSCDKTHTCPPCPAPEAAGGPSVFL<br>FPPKPKDTLMISRTPEVTCVVVDVSHEDPEVKFNWYVDGVEV<br>HNAKTKPREEQYNSTYRVVSVLTVLHQDWLNGKEYKCKVS<br>NKALPAPIEKTISKAKGQPREPAVYTLPPSRDELTKNQVKLVC<br>LVTGFYPSDIAVEWESNGQPENNYYTTPPVLDSDGSFSLVSW<br>LNVDKSRWQQGNVFSCSVMHEALHNHYTQKSLSLSPGK |
| SEQ ID NO: 169 -<br>BEAT CD38-<br>HB7bestfit/CD3<br>antibody FAB heavy<br>chain (CD38 arm -<br>humanized HB-7 best-<br>fit) | QVQLQESGPGLVKPSETLSLTCTVSGFSLISYGVHWVRQPPGK<br>GLEWLGVIWRGGSTDYNAAFMSRLTISKDNSKNQVSLKLSSV<br>TAADTAVYFCAKTLITTGYAMDYWGQGTLVTVSSASTKGPS<br>VFPLAPSSKSTSGGTAALGCLVKDYFPEPVTVSWNSGALTSG<br>VHTFPAVLQSSGLYSLSSVVTVPSSSLGTQTYICNVNHKPSNT<br>KVDKKVEPKSCDKTHTCPPCPAPEAAGGPSVFLFPPKTKDTL<br>MISRTPEVTCVVVDVSHEDPEVKFNWYVDGVEVHNAKTKPR<br>EEQYNSTYRVVSVLTVLHQDWLNGKEYKCKVSNKALPAPIE<br>KTISKAKGQPREPAVYTLPPSRDELTKNQVKLVCLVTGFYPSD<br>IAVEWESNGQPENNYYTTPPVLDSDGSFSLVSWLNVDKSRW<br>QQGNVFSCSVMHEALHNHYTQKSLSLSPGK |
| SEQ ID NO: 170 -<br>BEAT CD38-767/CD3<br>antibody FAB heavy<br>chain (CD38 arm -<br>human clone 767) | QVQLQESGPGLVKPSETLSLTCTVSGFSLISYGVHWVRQPPGK<br>GLEWLGVIWRGGSTDYNAAFMSRLTISKDNSKNQVSLKLSSV<br>TAADTAVYFCAKTLITTGYAMDYWGQGTLVTVSSASTKGPS<br>VFPLAPSSKSTSGGTAALGCLVKDYFPEPVTVSWNSGALTSG<br>VHTFPAVLQSSGLYSLSSVVTVPSSSLGTQTYICNVNHKPSNT<br>KVDKKVEPKSCDKTHTCPPCPAPEAAGGPSVFLFPPKPKDTL<br>MISRTPEVTCVVVDVSHEDPEVQFKWYYDGVEVHNAKTKPR<br>EEQYNSTFRVVSVLTVLHQDWLNGKEYKCKVSNKALPAPIE<br>KTISKTKGQPREPAVYTLPPSREEMTKNQVKLVCLVLVTGFYPS<br>DIAVEWESSGQPENNYYTTPPMLDSDGSFSLVSWLNVDKSR<br>WQQGNIFSCSVMHEALHNRFTQKSLSLSPGK |
| SEQ ID NO: 171 -<br>BEAT CD38-767/CD3<br>antibody scFv heavy<br>chain(CD3 epsilon arm -<br>humanized OKT3 with<br>G65S substitution) | EVQLVESGGGLVQPGGSLLKLSCAASGFTFNKYAMNWVRQAP<br>GKGLEWVARIRSKYNNYATYYADSVKDRFTISRDDSKNTAY<br>LQMNNLKTEDTAVYYCVRHGNFGNSYISYWAYWGQGTLVT<br>VSSGGGGSGGGGSGGGGSQTVVTQEPSLTVSPGGTVTLTCGSS<br>TGAVTSGNYPNWVQQKPGQAPRGLIGGTKFLAPGTPARFSG<br>SLLGGKAALTLSGVQPEDEAEYYCVLWYSNRWVFGGGTKLT<br>VLGGGGGTDKTHTCPPCPAPEAAGGPSVFLFPPKPKDTLMISR<br>TPEVTCVVVDVSHEDPEVKFNWYVDGVEVHNAKTKPREEQY<br>NSTYRVVSVLTVLHQDWLNGKEYKCKVSNKALPAPIEKTISK<br>AKGQPREPEVATFPPSRDELTKNQVTLVCLVTGFYPSDIAVE<br>WESNGQPENNYKTDPPLLESQGSFALSSRLRVDKSRWQQGN<br>VFSCSVMHEALHNHYTQKSLSLSPGK |
| SEQ ID NO: 172 -<br>BEAT OX40/CD3<br>antibody FAB heavy | QVTLKESGPALVKPTQTLTLTCSFSGFSLSTSGMGVGWIRQPP<br>GKALEWIAHIWWDDDKYYNTALKTRLTISKDTSKNQVVLTM<br>TNMDPVDTATYYCARIDWDGFAYWGQGTLVTVSSASTKGPS |

| | |
|---|---|
| chain (OX40 arm with humanized anti-human OX40 VH domain from WO2013/008171) | VFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTL MISRTPEVTCVVVDVSHEDPEVKFNWYVDGVEVHNAKTKPR EEQYNSTYRVVSVLTVLHQDWLNGKEYKCKVSNKALPAPIE KTISKAKGQPREPAVYTLPPSRDELTKNQVKLVCLVTGFYPSD IAVEWESNGQPENNYYTTPPVLDSDGSFSLVSWLNVDKSRW QQGNVFSCSVMHEALHNHYTQKSLSLSPGK |
| SEQ ID NO: 173 - BEAT OX40/CD3 antibody FAB light chain (OX40 arm with humanized anti-human OX40 VL domain from WO2013/008171) | EIVILTQSPATLSLSPGERATLSCRASSSVSYMHWYQQKPGQAP RPWIYATSNRATGIPARFSGSGSGTDYTLTISSLEPEDFAVYYC QQWSSNPWTFGQGTKVEIKRTVAAPSVFIFPPSDEQLKSGTAS VVCLLNNFYPREAKVQWKVDNALQSGNSQESVTEQDSKDST YSLSSTLTLSKADYEKHKVYACEVTHQGLSSPVTKSFNRGEC |
| SEQ ID NO: 174 - BEAT EGFR/CD3 antibody FAB heavy chain (EGFR arm with mouse Erbitux VH domain) | QVQLKQSGPGLVQPSQSLSITCTVSGFSLTNYGVHWVRQSPG KGLEWLGVIWSGGNTDYNTPFTSRLSINKDNSKSQVFFKMNS LQSNDTAIYYCARALTYYDYEFAYWGQGTLVTVSAASTKGP SVFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTL MISRTPEVTCVVVDVSHEDPEVKFNWYVDGVEVHNAKTKPR EEQYNSTYRVVSVLTVLHQDWLNGKEYKCKNSNKALPAPIE KTISKAKGQPREPAVYTLPPSRDELTKNQVKLVCLVTGFYPSD IAVEWESNGQPENNYYTTPPVLDSDGSFSLVSWLNVDKSRW QQGNVFSCSVMHEALHNHYTQKSLSLSPGK |
| SEQ ID NO: 175 - BEAT EGFR/CD3 antibody FAB light chain (EGFR arm with mouse Erbitux VL domain) | DILLTQSPVILSVSPGERVSFSCRASQSIGTNIHWYQQRTNGSP RLLIKYASESISGIPSRFSGSGSGTDFTLSINSVESEDIADYYCQ QNNNWPTTFGAGTKLELKRTVAAPSVFIFPPSDEQLKSGTASV VCLLNNFYPREAKVQWKVDNALQSGNSQESVTEQDSKDSTY SLSSTLTLSKADYEKHKIKVYACEVTHQGLSSPVTKSFNRGEC |
| SEQ ID NO: 176 - BEAT CD38-HB7bestfit/CD3(SP34) antibody FAB heavy chain (CD38 arm - humanized HB-7 best-fit) | QVQLQESGPGLVKPSETLSLTCTVSGFSLISYGVHWVRQPPGK GLEWLGVIWRGGSTDYNAAFMSRLTISKDNSKNQVSLKLSSV TAADTAVYFCAKTLITTGYAMDYWGQGTLVTVSSASTKGPS VFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTL MISRTPEVTCVVVDVSHEDPEVQFKWYVDGVEVHNAKTKPR EEQYNSTFRVVSVLTVLHQDWLNGKEYKCKVSNKALPAPIE KTISKTIKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPGK |
| SEQ ID NO: 177 - BEST CD38-HB7bestfit/CD3(SP34) antibody scFv heavy chain (CD3 arm - humanized SP34 VH/VL domains from WO2008/119565) | EVQLVESGGGLVQPGGSLKLSCAASGFTFNKYAMNWVRQAP GKGLEWVARIRSKYNNYATYYADSVKDRFTISRDDSKNTAY LQMNNLKTEDTAVYYCVRHGNFGNSYISYWAYWGQGTLVT VSSGGGGSGGGGSGGGGSQTVVTQEPSLTVSPGGTVTLTCGS STGAVTSGNYPNWVQQKPGQAPRGLIGGTKFLAPGTPARFSG SLLGGKAALTLSGVQPEDEAEYYCVLWYSNRWVFGGGTKLT VLGGGGGTDKTHTCPPCPAPEAAGGPSVFLFPPKPKDTLMISR TPEVTCVVVDVSHEDPEVKFNWYVDGVEVHNAKTKPREEQY NSTYRVVSVLTVLHQDWLNGKEYKCKVSNKALPAPIEKTISK AKGQPREPEVATFPPSRDELTKNQVTLVCLVTGFYPSDIAVE WESNGQPENNYKTDPPLLESQGSFALSSRLRVDKSRWQQGN VFSCSVMHEALHNHYTQKSLSLSPGK |
| SEQ ID NO: 178 - BEAT CD38-9G7bestfit/CD3(SP34) antibody FAB heavy chain (CD38 arm - humanized 9G7 best-fit VH) | QVTLKESGPTLVKPTQTLTLTCTFSGLSLSTSGKGVGWIRQPP GKALEWLAHIWWDDDKRYNPALKSRLTITKDTSKNQVVLT MTNMDPVDTATYYCARIELGRSYVMDYWGQGTLVTVSSAS TKGPSVFPLAPSSKSTSGGTAALGCLVKDYFPEPVTVSWNSG ALTSGVHTFPAVLQSSGLYSLSSVVTVPSSSLGTQTYICNVNH KPSNTKVDKKVEPKSCDKTHTCPPCPAPEAAGGPSVFLFPPKP KDTILMISRTPEVTCVVVDVSHEDPEVQFKWYVDGVEVHNAK TKPREEQYNSTFRVVSVLTVLHQDWLNGKEYKCKVSNKALP APIEKTISKTKGQPREPAVYTLPPSREEMTKNQVKLVCLVTGF YPSDIAVEWESSGQPENNYYTTPPMLDSDGSFSLVSWLNVDK SRWQQGNIFSCSVMHEALHNRFTQKSLSLSPGK |
| SEQ ID NO: 179 - BEAT CD38-9G7bestfit/CD4SP34-Kappa2) antibody scFv | EVQLVESGGGLVQPGGSLRLSCAASGFTFNTYAMNWVRQAP GKGLEWVARIRSKYNNYATYYADSVKGRFTISRDDSKNTLY LQMNSLRAEDTAVYYCVRHGNFGNSYVSWFAYWGQGTTVT VSSGGGGSGGGGSGGGGSEIVVTQSPATLSVSPGERATLSCRS |

| | Sequence listing |
|---|---|
| heavy chain (CD3 arm - humanized SP34 VH5/VL32) | STGAVTTSNYANWVQEKPGQAFRGLIGGANKRAPGVPARFS GSLSGDXATLTISSLQSEDFAVYYCALWYSNLWVFGQGTKLE IKGGGGTDKTHTCPPCPAPEAAGGPSVFLFPPKPKDTLMISRT PEVTCVVVDVSHEDPEVKFNWYVDGVEVHNAKTKPREEQY NSTYRVVSVLTVLHQDWLNGKEYKCKVSNKALPAPIEKTISK AKGQPREPEVATFPPSRDELTKNQVTLVCLVTGFYPSDIAVE WESNGQPENNYKTDPPLLESQGSFALSSRLRVDKSRWQQGN VFSCSVMHEALHNHYTQKSLSLSPGK |
| SEQ ID NO: 180 - BEAT CD20/CD3 antibody FAB heavy chain | QVQLQQPGAELVKPGASVKMSCKASGYTFTSYNMHWVKQT PGRGLEWIGAIYPGNGDTSYNQKFKGKATLTADKSSSTAYM QLSSLTSEDSAVYYCARSTYYGGDWYFNVWGAGTTVTVSAA STKGPSVFPLAPSSKSTSGGTAALGCLVKDYFPEPVTVSWNSG ALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVQFKWYVDGVEVHNAK TKPREEQYNSTFRVVSVLTVLHQDWLNGKEYKCKVSNKALP APIEKTISKTKGQPREPAVYTLPPSREEMTKNQVKLVCLVTGF YPSDIAVEWESSGQPENNYYTTPMLDSDGSFSLVSWLNVDK SRWQQGNIFSCSVMHEALHNRFTQKSLSLSPGK |
| SEQ ID NO: 181 - BEAT CD20/CD3 antibody FAB light chain | QIVLSQSPAILSASPGEKVTMETTCRASSSVSYIHWFQQKPGSS PKPWIYATSNLASGYPVRFSGSGSGTSYSLTISRVEAEDAATY YCQQWTSNPPTFGGGTKLEIKRTVAAPSVFIFPPSDEQLKSGT ASVVCLLNNFYPREAKVQWKVDNALQSGNSQESVTEQDSKD STYSTSSTLTLSKADYEKHKVYACEVTHQGLSSPVTKSFNRG EC |
| SEQ ID NO: 182 - Humanized SP34 VH domain from WO2008/119565 | QVQLQQPGAELVKPGASVKMSCKASGYTFTSYNMHWVKQT PGRGLEWIGAIYPGNGDTSYNQKFKGKATLTADKSSSTAVM QLSSLTSEDSAVYYCARSTYYGGDWYFNVWGAGTTVTVSA |
| SEQ ID NO: 183 - Humanized SP34 VL domain from WO2008/119565 | QVQLQQPGAELVKPGASVKMSCKASGYTFTSYNMHWVKQT PGRGLEWIGAIYPGNGDTSYNQKFKGKATLTADKSSSTAVM QLSSLTSEDSAVYYCARSTYYGGDWYFNVWGAGTTVTVSA |
| SEQ ID NO: 184 - Human CD3 gamma extracellular region | QSIKGNHLVKVYDYQEDGSVLLTCDAEAKNITWFKDGKMIG FLTEDKKKWNLGSNAKDPRGMYQCKGSQNKSKPLQVYYRM CQNCIELNAATIS |
| SEQ ID NO. 185 - Human CD3 epsilon extracellular region | DGNEEMGGITQTPYKVSISGTTVILTCPQYPGSEILWQHNDKN IGGDEDDKNIGSDEDHLSLKEFSELEQSGYVVCYPRGSKPEDA NFYLYLRARVCENCMEMD |
| SEQ ID NO: 186 - 26-residue peptide linker | GSADDAKKDAAKKDDAKKDDAKKDGS |
| SEQ ID NO: 187 - Human CD3 gamma-epsilon-Fc fusion protein | QSIKGNHLVKVYDYQEDGSVLLTCDAEAKNITWFKDGKMIG FLTEDKKKWNLGSNAKDPRGMYQCKGSQNKSKPLQVYYRM GSADDAKKDAAKKDDAKKDDAKKDGSQDGNEEMGGITQTP YKVSISGTTVILTCPQYPGSEILWQHNDKNIGGDEDDKNIGSD EDHLSLKEFSELEQSGYYVCYPRGSKPEDANFYLYLRARVGG GGTDKTHTCPPCPAPELLGGPSVFLFPPKPKDTLMISRTPEVTC VVVDVSHEDPEVKFNWYVDGVEVHNAKTKPREEQYNSTYR VVSVLTVLHQDWLNGKEYKCKVSNKALPAPIEKTISKAKGQP REPQVYTLPPSRDELTKNQVSLTCLVKGFYPSDIAVEWESNG QPENNYKTTPPVLDSDGSFFLYSKLTVDKSRWQQGNVFSCSV MHEALHNHYTQKSLSLSPG |
| SEQ ID NO: 188 - Human CD3 epsilon 1-26 amino acid sequence | QDGNEEMGGITQTPYKVSISGTTVIL |
| SEQ ID NO: 189 - Cynomolgus monkey CD3 epsilon 1-26 amino acid sequence | QDGNEEMGSITQTPYQVSISGTTVIL |
| SEQ ID NO: 190 - Human CD3 epsilon 1-26 Fc fusion | QDGNEEMGGITQTPYKVSISGTTVILGGGGTDKTHTCPPCPAP ELLGGPSVFLFPPKPKDTLMISRTPEVTCVVVDVSHEDPEVKF NWYVDGVEVHNAKTKPREEQYNSTYRVVSVLTVLHQDWLN GKEYKCKVSNKALPAPIEKTISKAKGQPREPQVYTLPPSRDEL TKNQVSLTCLVKGFYPSDIAVEWESNGQPENNYKTTPPVLDS DGSFFLYSKLTVDKSRWQQGNVFSCSVMHEALHNHYTQKSL SLSPGK |

| Sequence listing | |
|---|---|
| SEQ ID NO: 191 - Cynomolgus monkey CD3 epsilon 1-26 Fc fusion | QDGNEEMGSITQTPYQVSISGTTVILGGGGTDKTHTCPPCPAP ELLGGPSVFLFPPKPKDTLMLSRTPEVTCVVVDVSHEDPEVKF NWYVDGVEVHNAKTKPREEQYNSTYRVVSVLTVLHQDWLN GKEYKCKVSNKALPAPIEKTISKAKGQPREPQVYTLPPSRDEL TKNQVSLTCLVKGFYPSDIAVEWESNGQPENNYKTTPPVLDS DGSFFLYSKLTVDKSRWQQGNVFSCSVMHEALHNHYTQKSL SLSPGK |
| SEQ ID NO: 192 - Human CD38 extracellular region fused to a polyhistine tag - amino acid sequence | VPRWRQQWSGPGTTKRFPETVLARCVKYTEIHPEMRHVDCQ SVWDAFKGAFISKHPCNITEEDYQPLMKLGTQTVPCNKILLW SRIKDLAHQFTQVQRDMFTLEDTLLGYLADDLTWCGEFNTSK INYQSCPDWRKDCSNNPVSVFWKTVSRRFAEAACDVVHVML NGSRSKIFDKNSTFGSVEVHNLQPEKVQTLEAWVIHGGREDS RDLCQDPTIKELESIISKRNIQFSCKNIYRPDKFLQCVKNPEDSS CTSEIHHHHHH |
| SEQ ID NO: 193 - Cynomolgus monkey CD38 extracellular region fused to a polyhistine tag - amino acid sequence | VPRWRQQWSGSGTTSRFPETVLARCVKYTEVHPEMRHVDCQ SVWDAFKGAFISKYPCNITEEDYQPLVKLGTQTVPCNKTLLW SRIKDLAHQFTQVQRDMFTLEDMLLGYLADDLTWCGEFNTF EINYQSCPDWRKDCSNNPVSVFWKTVSRRFAETACGVVHVM LNGSRSKIFDKNSTFGSVEVHNLQPEKVQALEAWVIHGGRED SRDLCQDPTIKELESIISKRNIRFFCKNIYRPDKFLQCVKNPEDS SCLSGIHHHHHH |
| SEQ ID NO: 194 - Mouse anti- human CD3 epsilon OKT3 CDR H1 | GYTFTRYT |
| SEQ ID NO: 195 - Mouse anti- human CD3 epsilon OKT3 CDR H2 | INPSRGYT |
| SEQ ID NO: 196 - Mouse anti- human CD3 epsilon OKT3 CDR H3 | ARYYDDHYCLDY |
| SEQ ID NO: 197 - Mouse anti- human CD3 epsilon OKT3 CDR L1 | SSVSY |
| SEQ ID NO: 198 - Mouse anti- human CD3 epsilon OKT3 CDR L2 | DTS |
| SEQ ID NO: 199 - Mouse anti- human CD3 epsilon OKT3 CDR L3 | QQWSSNPPT |
| SEQ ID NO: 200 - Mouse anti- human CD3 epsilon SP34 CDR H1 | GFTFNTYA |
| SEQ ID NO: 201 - Mouse anti- human CD3 epsilon SP34 CDR H2 | IRSKYNNYAT |
| SEQ ID NO: 202 - Mouse anti- human CD3 epsilon SP34 CDR H3 | VRHGNFGNSYVSWFAY |
| SEQ ID NO: 203 - Mouse anti- human CD3 epsilon SP34 CDR L1 | TGAVTTSNY |
| SEQ ID NO: 204 - Mouse anti- human CD3 epsilon SP34 CDR L2 | GTN |
| SEQ ID NO: 205 - Mouse anti- human CD3 epsilon SP34 CDR L3 | ALWYSNLWV |
| SEQ ID NO: 206 - Herceptin (trastuzumab)CDR H1 | GFNIKDTY |

| Sequence listing | |
|---|---|
| SEQ ID NO: 207 - Herceptin (trastuzumab) CDR H2 | IYPTNGYT |
| SEQ ID NO: 208 - Herceptin (trastuzumab) CDR H3 | SRWGGDGFYAMDY |
| SEQ ID NO: 209 - Herceptin (trastuzumab) CDR L1 | QDVNTA |
| SEQ ID NO: 210 - Herceptin (trastuzumab) CDR L2 | SAS |
| SEQ ID NO: 211 - Herceptin (trastuzumab) CDR L3 | QQHYTTPPT |
| SEQ ID NO: 212 - Mouse anti- human CD38 HB-7 CDR H1 | GFSLISYG |
| SEQ ID NO: 213 - Mouse anti- human CD38 HB-7 CDR H2 | IWRGGST |
| SEQ ID NO: 214 - Mouse anti- human CD38 HB-7 CDR H3 | AKTLITTGYAMDY |
| SEQ ID NO: 215 - Mouse anti- human CD38 HB-7 CDR L1 | EDIYNR |
| SEQ ID NO: 216 - Mouse anti- human CD38 HB-7 CDR L2 | GAT |
| SEQ ID NO: 217 - Mouse anti- human CD38 HB-7 CDR L3 | QQYWSTPT |
| SEQ ID NO: 218 - Mouse anti- human CD38 OKT10 CDR H1 | GFDFSRSW |
| SEQ ID NO: 219 - Mouse anti- human CD38 OKT10 CDR H2 | INPDSSTI |
| SEQ ID NO: 220 - Mouse anti- human CD38 OKT10 CDR H3 | ARYGNWFPY |
| SEQ ID NO: 221 - Mouse anti- human CD38 OKT10 CDR L1 | QNVDTN |
| SEQ ID NO: 222 - Mouse anti- human CD38 OKT10 CDR L2 | SAS |
| SEQ ID NO: 223 - Mouse anti- human CD38 OKT10 CDR L3 | QQYDSYPLTFGAGTK |
| SEQ ID NO: 224 - Mouse anti- human CD38 9G7 CDR H1 | GLSLSTSGKG |
| SEQ ID NO: 225 - Mouse anti- human CD38 9G7 CDR H2 | IWWDDDK |

| Sequence listing | |
|---|---|
| SEQ ID NO: 226 - Mouse anti-human CD38 9G7 CDR H3 | ARIELGRSYVMDY |
| SEQ ID NO: 227 - Mouse anti-human CD38 9G7 CDR L1 | QDVITS |
| SEQ ID NO: 228 - Mouse anti-human CD38 9G7 CDR L2 | SAS |
| SEQ ID NO: 229 - Mouse anti-human CD38 9G7 CDR L3 | QQHYTIPLT |
| SEQ ID NO: 230 - Human anti-human CD38 767 CDR H1 | GFTFSSYW |
| SEQ ID NO: 231 - Human anti-human CD38767 CDR H2 | IKQDGSEK |
| SEQ ID NO: 232 - Human anti-human CD38767 CDR H3 | AREGRTGYFDY |
| SEQ ID NO: 233 - Human anti-human CD38767 CDR L1 | TSNIGTNY |
| SEQ ID NO: 234 - Human anti-human CD38767 CDR L2 | RND |
| SEQ ID NO: 235 - Human anti-human CD38767 CDR L3 | AAWDDSRSGVYA |
| SEQ ID NO: 236 - Mouse anti-human OX40 CDR H1 from WO2013/008171 | GFSLSTSGMG |
| SEQ ID NO: 237 - Mouse anti-human OX40 CDR H2 from WO2013/008171 | IWWDDDK |
| SEQ ID NO: 238 - Mouse anti-human OX40 CDR H3 from WO2013/008171 | ARIDWDGFAY |
| SEQ ID NO: 239 - Mouse anti-human OX40 CDR L1 from WO2013/008171 | SSVSY |
| SEQ ID NO: 240 - Mouse anti-human OX40 CDR L2 from WO2013/008171 | ATS |
| SEQ ID NO: 241 - Mouse anti-human OX40 CDR L3 from WO2013/008171 | QQWSSNPWT |
| SEQ ID NO: 242 - Rituxan (rituxitnab) CDR H1 | GYTFTSYN |

| Sequence listing | |
|---|---|
| SEQ ID NO: 243 -<br>Rituxan (rituximab)<br>CDR H2 | IYPGNGDT |
| SEQ ID NO: 244 -<br>Rituxan (rituximab)<br>CDR H3 | ARSTYYGGDWYFNV |
| SEQ ID NO: 245 -<br>Rituxan (rituximab)<br>CDR L1 | ASSSVSY |
| SEQ :ID NO: 246 -<br>Rituxan (rituximab)<br>CDR L2 | ATS |
| SEQ ID NO: 247 -<br>Rituxan (rituximab)<br>CDR L3 | QQWTSNPPT |
| SEQ ID NO: 248 -<br>Erbitux (cetuximab)<br>CDR H1 | GFSLTNYG |
| SEQ ID NO: 249 -<br>Erbitux (cetuximab)<br>CDR H2 | IWSGGNT |
| SEQ ID NO: 250 -<br>Erbitux (cetuximab)<br>CDR H3 | ARALTYYDYEFAY |
| SEQ ID NO: 251 -<br>Erbitux (cetuximab)<br>CDR L1 | QSIGTN |
| SEQ ID NO: 252 -<br>Erbitux (cetuximab)<br>CDR L2 | YAS |
| SEQ ID NO: 253 -<br>Erbitux (cetuximab)<br>CDR L3 | QQNNNWPTT |
| SEQ ID NO: 254 -<br>Vectibix (panitumumab)<br>CDR H1 | GGSVSSGDYY |
| SEQ ID NO: 255 -<br>Vectibix (panitumumab)<br>CDR H2 | IYYSGNT |
| SEQ ID NO: 256 -<br>Vectibix (panitumumab)<br>CDR H3 | VRDRVTGAFDI |
| SEQ ID NO: 257 -<br>Vectibix (panitumumab)<br>CDR L1 | QDISNY |
| SEQ ID NO: 258 -<br>Vectibix (panitumumab)<br>CDR L2 | DAS |
| SEQ ID NO: 259 -<br>Vectibix (panitumumab)<br>CDR L3 | QHFDHLPLA |
| SEQ ID NO: 260 -<br>Mouse anti-human<br>CD19 CDR H1 from<br>WO2010/095031 | GVSLPDYG |

| Sequence listing | |
|---|---|
| SEQ ID NO: 261 -<br>Mouse anti-human<br>CD19 CDR H2 from<br>WO2010/095031 | IWGSETT |
| SEQ ID NO: 262 -<br>Mouse anti-human<br>CD19 CDR H3 from<br>WO2010/095031 | AKHYYYGGSYAMDY |
| SEQ ID NO: 263 -<br>Mouse anti-human<br>CD19 CDR L1 from<br>WO2010/095031 | QDISKY |
| SEQ ID NO: 264 -<br>Mouse anti-human<br>CD19 CDR L2 from<br>WO2010/095031 | HTS |
| SEQ ID NO: 265 -<br>Mouse anti-human<br>CD19 CDR L3 from<br>WO2010/095031 | QQGATLPYT |
| SEQ ID NO: 266 -<br>Bsw17 CDR H1 | GFTFSSYA |
| SEQ ID NO: 267 -<br>Bsw17 CDR H2 | ISSGNII |
| SEQ ID NO: 268 -<br>Bsw17 CDR H3 | TRGRSTYGGFDH |
| SEQ ID NO: 269 -<br>Bsw17 CDR L1 | SSVTF |
| SEQ ID NO: 270 -<br>Bsw17 CDR L2 | DTS |
| SEQ ID NO: 271 -<br>Bsw17 CDR L3 | QHWSGNPLT |
| SEQ ID NO: 272 -<br>Omalizumab CDR H1 | GYSITSGYS |
| SEQ ID NO: 273 -<br>Omalizumab CDR H2 | ITYDGST |
| SEQ ID NO: 274 -<br>Omalizumab CDR H3 | ARGSHYFGHWHFAV |
| SEQ ID NO: 275 -<br>Omalizumab CDR L1 | QSVDYDGDSY |
| SEQ ID NO: 276 -<br>Omalizumab CDR L2 | AAS |
| SEQ ID NO: 277 -<br>Omalizumab CDR L3 | QQSHEDPYT |
| SEQ ID NO: 278 -<br>Humanized anti-<br>OX40/mingraft VH<br>domain | EVQLVESGGGLVQPGGSLRLSCAASGFSTSTSGMGMSWVRQ<br>APGKGLEWVSAIWWDDDKYYADSVKGRFTISRDNSKNTLYL<br>QMNSLRAEDTAVYYCARIDWDGFAYWGQGTLVTVSS |
| SEQ ID NO: 279-<br>Humanized anti-<br>OX40/maxgraft VH<br>domain | EVQLVESGGGLVQPGGSLRLSCAFSGFSLSTSGMGVGWIRQA<br>PGKGLEWLAHIWWDDDKYYNTALKSGLTISKDTSKNTVYLQ<br>MNSLRAEDTAVYYCARIDWDGFAYWGQGTLVTVSS |
| SEQ ID NO: 280 -<br>Humanized anti-<br>OX40/mingraft VL<br>domain | DIQMTQSPSSLSASVGDRVTITCRASSSVSYLNWYQQKPGKA<br>PKLLIYATSSLQSGVPSRFSGSGSGTDFTLTISSLQPEDFATYYC<br>QQWSSNPWTFGQGTKVEIK |

| Sequence listing | |
|---|---|
| SEQ ID NO: 281 - Humanized anti-OX40/maxgraft VL domain | DIQLTQSPSSLSASVGDRVTITCRASSSVSYMHWYQQKPGKAPKPWIYATSNLASGVPSRFSGSGSGTDYTLTISSLQPEDFATYYCQQWSSNPWTFGQGTKVEIK |
| SEQ ID NO: 282 - Humanized Rituximab/mingraft VH domain | EVQLVESGGGLVQPGGSLRLSCAASGYTFTSYNMSWVRQAPGKGLEWVSAIYPGNGDTYYADSVKGRFTISRDNSKNTLYLQMNSLRAEDTAVYYCARSTYYGGDWYFNVWGQGTLVTVSS |
| SEQ ID NO: 283 - Humanized Rituximab/maxgraft VH domain | EVQLVESGGGLVQPGGSLRLSCAASGYTFTSYNMSWVRQAPGKGLEWIGAIYPGNGDTYYADSVKGRATLSADKSKNTAYLQMNSLRAEDTAVYYCARSTYYGGDWYFNVWGQGTLVTVSS |
| SEQ ID NO: 284 - Humanized Rituximab/mingraft VL domain | DIQMTQSPSSLSASVGDRVTITCRASASSSVSYLNWYQQKPGKAPKLLIYATSSLQSGVPSRFSGSGSGTDFTLTISSLQPEDFATYYCQQWTSNPPTFGQGTKVEIK |
| SEQ ID NO: 285 - Humanized Rituximab/maxgraft VL domain | DIQLTQSPSSLSASVGDRVITCRLSASSSVSYLNWFQQKPGKAPKPWIYATSSLQSGVPSRFSGSGSGTDYTLTISSLQPEDFATYYCQQWTSNPPTFGQGTKVEIK |
| SEQ ID NO: 286 - Humanized Erbitux/mingraft VH domain | EVQLVESGGGLVQPGGSLRLSCAASGFSLTNYGMSWVRQAPGKGLEWVSAIWSGGNTYYADSVKGRFTISRDNSKNTLYLQMNSLRAEDTAVYYCARALTYYDYEFAYWGQGTLVTVSS |
| SEQ ID NO: 287 - Humanized Erbitux/maxgraft VH domain | EVQLVESGGGLVQPGGSLRLSCAASGFSLTNYGVHWVRQAPGKGLEWLGAIWSGGNTDYNTPFTGRLTISKDNSKNTLYLQMNSLRAEDTAVYYCARALTYYDYEFAYWGQGTLVTVSS |
| SEQ ID NO: 288 - Humanized Erbitux/mingraft VL domain | DIQMTQSPSSLSASVGDRVTITCRASQSIGTNLNWYQQKPGKAPKLLIYYASSLQSGVPSRFSGSGSGTDFTLTISSLQPEDFATYYCQQNNNWPTTFGQGTKVEIK |
| SEQ ID NO: 289 - Humanized Erbitux/maxgraft VL domain | DIQLTQSPSSLSASVGDRVTITCRASQSIGTNIHWYQQKPGKAPKLLIKYASESISGVPSRFSGSGSGTDFTLTISSLQPEDFATYYCQQNNNWPTTGGQGTKVEIK |
| SEQ ID NO: 290 - Vectibix VH domain | QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSS |
| SEQ ID NO: 291 - Vectibix VL domain | DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIK |
| SEQ ID NO: 292 - Humanized Vectiblx/mingraft VH domain | EVQLVESGGGLVQPGGSLRLSCAASGGSVSSGDYYMSWVRQAPGKGLEWVSAIYYSGNTYYADSVKGRFTISRDNSKNTLYLQMNSLRAEDTAVYYCVRDRVTGAFDIWGQGTLVTVSS |
| SEQ ID NO: 293 - Humanized Vectiblx/maxgraft VH domain | EVQLVESGGGLVQPGGSLRLSCAVSGGSVSSGDYYMSWVRQAPGKGLEWIGAIYYSGNTYYADSVKGRLTISIDTSKNTFYLQMNSLRAEDTAVYYCVRDRVTGAFDIWGQGTLVTVSS |
| SEQ ID NO: 294 - Humanized Vectiblx/mingraft VL domain | DIQMTQSPSSLSASVGDRVTITCRASQDISNYLNWYQQKPGKAPKLLIYDASSLQSGVPSRFSGSGSGTDFTLTISSLQPEDFATYYCQHFDHLPLAFGQGTKVEIK |
| SEQ ID NO: 295 - Humanized Vectibix/maxgraft VL domain | DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIK |
| SEQ ID NO: 296 - anti-human CD19 VH domain from WO2010/095031 | QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSS |

| Sequence listing | |
|---|---|
| SEQ ID NO: 297 - anti-human CD19 VL domain from WO2010/095031 | DIQMTQSPSSLSASVGDRVTITCRASQDISKYLNWYQQKPGK AIKLLIYHTSRLHSGVPSRFSGSGSGTDFTLTISSLQPEDFATYY CQQGATLPYTFGPGTKVDIK |
| SEQ ID NO: 298 - Omalizumab VH domain | EVQLVESGGGLVQPGGSLRLSCAVSGYSITSGYSWNWIRQAP GKGLEWVASITYDGSTNYADSVKGRFTISRDDSKINTFYLQMN SLRAEDTAVYYCARGSHYFGHWHFAVWGQGTLVTVSS |
| SEQ ID NO: 299 - Omalizumab VL domain | DIQLTQSPSSLSASVGDRVTITCRASQSVDYDGDSYMNWYQQ KPGKAPKLLIYAASYLESGVPSRFSGSGSGTDFTLTISSLQPED FATYYCQQSHEDPYTFGQGTKVEIK |
| SEQ ID NO: 300 - Stabilized Omalizumab/maxgraft VH domain | EVQLVESGGGLVQPGGSLRLSCAVSGYSITSGYSWNWIRQAP GKGLEWVASITYDGSTNYADSVKGRFTISRDDSKNTFYLQMN SLRAEDTAVYYCARGSHYFGHWHFAVWGQGTLVTVSS |
| SEQ ID NO: 301 - Stabilized Omalizumab/mingraft VH domain | EVQLVESGGGLVQPGGSLRLSCAASGYSITSGYSMSWVRQAP GKGLEWVSAITYDGSTYYADSVKGRFTISRDNSKNTLYLQM NSLRAEDTAVYYCARGSHYFGHWHFAVWGQGTLVTVSS |
| SEQ ID NO: 302 - Stabilized Omalizumab/maxgraft VL domain | DIQLTQSPSSLSASVGDRVTITCRASQSVDYDGDSYMNWYQQ KPGKAPKLLIYAASYLESGVPSRFSGSGSGTDFTLTISSLQPED FATYYCQQSHEDPYTFGQGTKVEIK |
| SEQ ID NO: 303 - Stabilized Omalizumab/mingraft VL domain | DIQMTQSPSSLSASVGDRVTITCRASQSVDYDGDSYLNWYQQ KPGKAPKLLIYAASSLQSGVPSRFSGSGSGTDFTLTISSLQPED FATYYCQQSHEDPYTFGQGTKVEIK |
| SEQ ID NO: 304 - Bsw17 mouse VH domain | EVQLLESGGGFVKPGGSLKLSCVVSGFTFSSYAMSWVRQTPE KRLEWVASISSGNIIYYPDNVKGRFTISRDNVRNILYLQMSSL RSEDTAMYYCTRGRSTYGGFDHWGQGTTLTVSS |
| SEQ ID NO: 305 - Bsw17 mouse VL domain | ELVMTQSPAIMSASPGEKVTMTCSASSSVTFIHWYRQKSGTSP KGWIYDTSKLASGVPARFSGSGSGTSYSLTISTMEAEDAATY YCQHWSGNPLTFGTGTKLELK |
| SEQ ID NO: 306 - Humanized Bsw17/mingraft VH domain | EVQLVESGGGLVQPGGSLRLSCAASGFTFSSYAMSWVRQAP GKGLEWVSAISSGNIIYYADSVKGRFTISRDNSKNTLYLQMNS LRAEDTAVYYCTRGRSTYGGFDHWGQGTLVTVSS |
| SEQ ID NO: 307 - Humanized Bsw17/maxgraft VH domain | EVQLVESGGGLVKPGGSLRLSCAVSGFTFSSYAMSWVRQAP GKGLEWVASISSGNIIYYPDNVKGRFTISRDNAKNSLYLQMNS LRAEDTAVYYCTRGRSTYGGFDHWGQGTTVTVSS |
| SEQ ID NO: 308 - Humanized Bsw17/mingraft VL domain | DIQMTQSPSSLSASVGDRVTITCRASSSVTFLNWYQQKPGKAP KLLIYDTSSLQSGVPSRFSGSGSGTDFTLTISSLQPEDFATYYC QHWSGNPLTFGQGTKVEIK |
| SEQ ID NO: 309 - Humanized Bsw17/maxgraft VL domain | DLQMTQSPSSLSASVGDRVTITCSASSSVTFLNWYQQKPGKA PWLLIYDTSSLQSGVPSRFSGSGSGTDYTLTISSMQPEDFATYY CQHWSGNPLTFGQGTKVE1K |
| SEQ ID NO: 310 - BEAT HER2/CD3(SP34-Kappa2) antibody FAB heavy chain (anti-HER2 FAB arm with G65S substitution BT33 LALA) | EVQLVESGGGLVQPGGSLRLSCAASGFNIKDTYIHWVRQAPG KGLEWVARIYPTNGYTRYADSVKSRFTISADTSKNTAYLQMN SLRAEDTAVYYCSRWGGDGFYAMDYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKVDKKVEPKSCDKTHTCPPCPAPEAAGGPSVFLFPPKPKD TLMISRTPEVTCVVVDVSHEDPEVQFKWYVDGVEVHNAKTK PREEQYNSTFRVVSVLTVLHQDWLNGKEYKCKVSNKALPAPI EKTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 311 - BEAT antibody scFv heavy chain SP34- | EVQLVESGGGLVQPGGSLRLSCAASGFTFNTYAMNWVRQAP GKGLEWVARIRSKYNNYATYYADSVKGRFTISRDDSKNTLY LQMNSLRAEDTAVYYCVRHGNFGNSYVSYFAYWGQGTTVT |

| Sequence listing | |
|---|---|
| Kappa2(anti-CD3 epsilon arm - humanized SP34 VH5/VL32 BT11 LALA) | VSSGGGGSGGGGSGGGGSEIVVTQSPATLSVSPGERATLSCRS STGAVTAANYANWVQEKPGQAFRGLIGGANKRAPGVPARFS GSLSGDEATLTISSLQSEDFAVYYCALFYSNLWVFGQGTKLEI KGGGGTDKTHTCPPCPAPEAAGGPSVFLFPPKPKDTLMISRTP EVTCVVVDVSHEDPEVKFNWYVDGVEVHNAKTKPREEQYN STYRVVSVLTVLHQDWLNGKEYKCKVSNKALPAPIEKTISKA KGQPREPEVATFPPSRDELTKNQVTLVCLVTGFYPSDIAVEWE SNGQPENNYKTDPPLLESQGSFALSSRLRVDKSRWQQGNVFS CSVMHEALHNHYTQKSLSLSPG |
| SEQ ID NO: 312 - BEAT CD38-9G7bestframework/CD3 (SP34-Kappa2) antibody FAB heavy chain (anti-CD38 FAB arm with G65S substitution BT33 LALA) | EVQLVESGGGLVQPGGSLRLSCAASGFTFNTYAMNWVRQAP GKGLEWVARIRSKYNNYATYYADSVKGRFTISRDDSKNTLY LQMNSLRAEDTAVYYCVRHGNFGNSYVSWFAYWGQGTTVT VSSASTKGPSVFPLAPSSKSTSGGTAALGCLVKDYFPEPVTVS WNSGALTSGVHTFPAVLQSSGLYSLSSVVTVPSSSLGTQTYIC NVNHKPSNTKVDKKVEPKSCDKTHTCPPCPAPEAAGGPSVFL FPPKPKDTLMISRTPEVTCVVVDVSHEDPEVQFKWYVDGVEV HNAKTKPREEQYNSTFRVVSVLTVLHQDWLNGKEYKCKVSN KALPAPIEKTISKTKGQPREPAVYTLPPSREEMTKNQVKLVCL VTGFYRSDIAVEWESSGQPENNYYTTPPMLDSDGSFSLVSWL NVDKSRWQQGNIFSCSVMHEALHNRFTQKSLSLSPG |
| SEQ ID NO: 313 - BEAT CD38-767/CD3(SP34-Kappa2) antibody FAB heavy chain (anti-CD38 FAB arm with G65S substitution BT33 LALA) | EVQLVESGGGLVQPGGSLKLSCAASGFTFNKYAMNWVRQAP GKGLEWVARIRSKYNNYATYYADSVKDRFTISRDDSKNTAY LQMNNLKTEDTAVYYCVRHGNFGNSYISYWAYWGQGTLVT VSSASTKGPSVFPLAPSSKSTSGGTAALGCLVKDYFPEPVTVS WNSGALTSGVHTFPAVLQSSGLYSLSSVVTVPSSSLGTQTYIC NVNHKPSNTKVDKKVEPKSCDKTHTCPPCPAPEAAGGPSVFL FPPKPKDTLMISRTPEVTCVVVDVSHEDPEVQFKWYVDGVEV HNAKTKPREEQYNSTFRVVSVLTVLHQDWLNGKEYKCKVSN KALPAPIEKTISKTKGQPREPAVYTLPPSREEMTKNQVKLVCL VTGFYPSDIAVEWESSGQPENNYYTTPPMLDSDGSFSLVSWL NVDKSRWQQGNIFSCSVMHEALHNRFTQKSLSLSPG |
| SEQ ID NO: 314 - BEAT OX40maxgraft/CD3 (SP34-Kappa2) antibody FAB heavy chain (anti-OX40 maxgraft FAB arm with G65S substitution BT33 LALA) | EVQLVESGGGLVQPGGSLRLSCAFSGFSLSTSGMGVGWIRQA PGKGLEWLAHIWWDDDKYYNTALKSGLTISKDTSKNTVYLQ MNSLRAEDTAVYYCARIDWDGFAYWGQGTLVTVSSASTKGP SVFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTL MISRTPEVTCVVVDVSHEDPEVQFKWYVDGVEVHNAKTKPR EEQYNSTFRVVSVLTVLHQDWLNGKEYKCKVSNKALPAPIE KTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 315 - BEAT OX40maxgraft/CD3 (SP34-Kappa2) antibody FAB light chain (anti-OX40 maxgraft FAB arm LC) | DIQLTQSPSSLSASVGDRVTITCRASSSVSYMHWYQQKPGKA PKPWIYATSNLASGVPSRFSGSGSGTDYTLTISSLQPEDFATYY CQQWSSNPWTFGQGTKVEIKRTVAAPSVFIFPPPSDEQLKSGTA SVVCLLNNFYPREAKVQWKVDNALQSGNSQESVTEQDSKDS TYSLSSTLTLSKADYEKHKVYACEVTHQGLSSPVTKSFNRGE C |
| SEQ ID NO: 316 - BEAT OX40mingraft/CD3 (SP34-Kappa2) antibody FAB heavy chain (anti-OX40 mingraft FAB arm with G65S substitution BT33 LALA) | EVQLVESGGGLVQPGGSLRLSCAASGFSLSTSGMGMSWVRQ APGKGLEWVSAIWWDDDKYYADSVKSRFTISRDNSKNTYL QMNSLRAEDTAVYYCARIDWDGFAYWCQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKVDKKVEPKSCDKTHTCPPCPAPEAAGGPSVFLFPPKPKD TLMISRTPEVTCVVVDVSHEDPEVQFKWYVDGVEVHNAKTK PREEQYNSTFRVVSVLTVLHQDWLNGKEYKCKVSNKALPAPI EKTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 317 - BEAT OX40mingraft/CD3 (SP34-Kappa2) antibody FAB light chain (anti-OX40 mingraft FAB arm LC) | DIQMTQSPSSLSASVGDRVTITCRASSSVSYLNWYQQKPGKA PKLLIYATSSLQSGVPSRFSGSGSGTDFTLTISSLQPEDFATYYC QQWSSNPWTFGQGTKVEIKRTVAAPSVFIFPPSDEQLKSGTAS VVCLLNNFYPREAKVQWKVDNALQSGNSQESVTEQDSKDST YSLSSTLTLSKADYEKHKVYACEVTHQGLSSPVTKSFNRGEC |
| SEQ ID NO: 318 - BEAT CD20maxgraft/CD3 | EVQLVESGGGLVQPGGSLRLSCAASGYTFTSYNMSWVRQAP GKGLEWIGAIYPGNGDTYYADSVKSRATLSADKSKNTAYLQ MNSLRAEDTAVYYCARSTYYGGDWYFNVWGQGTLVTVSSA |

| | |
|---|---|
| (SP34-Kappa2) antibody FAB heavy chain (anti-CD20 maxgraft FAB arm with G65S substitution BT33 LALA) | STKGPSVFPLAPSSKSTSGGTAALGCLVKDYFPEPVTVSWNSG ALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVQFKWYVDGVEVHNAK TKPREEQYNSTFRVVSVLTVLHQDWLNGKEYKCKVSNKALP APIEKTISKTKGQPREPAVYTLPPSREEMTKNQVKLVCLVTGF YPSDIAVEWESSGQPENNYYTTPPMLDSDGSFSLVSWLNVDK SRWQQGNIFSCSVMHEALHNRFTQKSLSLSPG |
| SEQ ID NO: 319 - BEAT CD20maxgraft/CD3 (SP34-Kappa2) antibody FAB light chain (anti-CD20 maxgraft FAB arm LC) | DIQLTQSPSSLSASVGDRVTITCRLSASSSVSYLNWFQQKPGK APKPWIYATSSLQSGVPSRFSGSGSGTDYTLTISSLQPEDFATY YCQQWTSNPPTFGQGTKVEIKRTVAAPSVFIFPPSDEQLKSGT ASVVCLLNNFYPREAKVQWKVDNALQSGNSQESVTEQDSKD STYSLSSTLTLSKADYEKHKVYACEVTHQGLSSPVTKSFNRG EC |
| SEQ ID NO: 320 - BEAT CD20mingraft/CD3(ST34-Kappa2) antibody FAB heavy chain (anti-CD20 mingraft FAB arm with G65S substitution BT33 LALA) | EVQLVESGGGLVQPGGSLRLSCAASGYTFTSYNMSWVRQAP GKGLEWVSAIYPGNGDTYYADSVKSRFTISRDNSKNTLYLQM NSLRAEDTAVYYCARSTYYGGDWYFNVWGQGTLVTVSSAS TKGPSVFPLAPSSKSTSGGTAALGCLVKDYFPEPVTVSWNSG ALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVQFKWYVDGVEVHNAK TKPREEQYNSTFRVVSVLTVLHQDWLNGKEYKCKVSNKALP APIEKTISKTKGQPREPAVYTLPPSREEMTKNQVKLVCLVTGF YPSDIAVEWESSGQPENNYYTTPPMLDSDGSFSLVSWLNVDK SRWQQGNIFSCSVMHEALHNRFTQKSLSLSPG |
| SEQ ID NO: 321 - BEAT CD20mingraft/CD3 (SP34-Kappa2) antibody FAB light chain (anti-CD20 mingraft FAB arm LC) | DIQMTQSPSSLSASVGDRVTITCRASASSSVSYLNWYQQKPG KAPKLLIYATSSLQSGVPSRFSGSGSGTDFTLTISSLQPEDFAT YYCQQWTSNPPTFGQGTKVEIKRTVAAPSVFIFPPSDEQLKSG TASVVCLLNNFYPREAKVQWKVDNALQSGNSQESVTEQDSK DSTYSLSSTLTLSKADYEKHKVYACEVTHQGLSSPVTKSFNR GEC |
| SEQ ID NO: 322 - BEAT EGFRcetux-maxgraft/CD3(SP34-Kappa2) antibody FAB heavy chain (anti-EGFR cetuximab maxgraft FAB arm with G65S substitution BT33 LALA) | EVQLVESGGGLVQPGGSLRLSCAASGFSLTNYGVHWVRQAP GKGLEWLGAIWSGGNTDYNTPFTSRLTISKDNSKNTLYLQMN SLRAEDTAVYYCARALTYYDYEFAYWGQGTLVTVSSASTKG PSVFPLAPSSKSTSGGTAALGCLVKDYFPEPVTVSWNSGALTS GVHTFPAVLQSSGLYSLSSVVTVPSSSLGTQTYICNVNHKPSN TKVDKKVEPKSCDKTHTCPPCPAPEAAGGPSVFLFPPKPKDTL MISRTPEVTCVVVDVSHEDPEVQFKWYVDGVEVHNAKTKPR EEQYNSTFRVVSVLTVLHQDWLNGKEYKCKVSNKALPAPIE KTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 323 - BEAT EGFRcetux-maxgraft/CD3(SP34-Kappa2) antibody FAB light chain (anti-EGFR cetuximab maxgraft FAB arm) | DIQLTQSPSSLSASVGDRVTITCRASQSIGTNIHWYQQKPGKA PKLLIKYASESISGVPSRFSGSGSGTDFTLTISSLQPEDFATYYC QQNNNWPTTFGQGTKVEIKRTVAAPSVFIFPPSDEQLKSGTAS VVCLLNNFYPREAKVQWKVDNALQSGNSQESVTEQDSKDST YSLSSTLTLSKADYEKHKVYACEVTHQGLSSPVTKSFNRGEC |
| SEQ ID NO: 324 - BEAT EGFRcetux-mingraft/CD3(SP34-Kappa2) antibody FAB heavy chain (anti-EGFR cetuximab mingraft FAB arm with G65S substitution BT33 LALA) | EVQLVESGGGLVQPGGSLRLSCAASGFSLTNYGMSWVRQAP GKGLEWVSAIWSGGNTYYADSVKSRFTISRDNSKNTLYLQM NSLRAEDTAVYYCARALTYYDYEFAYWGQGTLVTVSSASTK GPSVFPLAPSSKSTSGGTAALGCLVKDYFPEPVTVSWNSGALT SGVHTFPAVLQSSGLYSLSSVVTVPSSSLGTQTYICNVNHKPS NTKVDKKVEPKSCDKTHTCPPCPAPEAAGGPSVFLFPPKPKD TLMISRTPEVTCVVVDVSHEDPEVQFKWYVDGVEVHNAKTK PREEQYNSTFRVVSVLTVLHQDWLNGKEYKCKVSNKALPAPI EKTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 325 - BEAT EGFRcetux-mingraft/CD3(SP34-Kappa2) antibody FAB light chain (anti-EGFR cetuximab mingraft FAB arm) | DIQMTQSPSSLSASVGDRVTITCRASQSIGTNLNWYQQKPGK APKLLIYYASSLQSGVPSRFSGSGSGTDFTLTISSLQPEDFATY YCQQNNNWPTTFGQGTKVEIKRTVAAPSVFIFPPSDEQLKSGT ASVVCLLNNFYPREAKVQWKVDNALQSGNSQESVTEQDSKD STYSLSSTLTLSKADYEKHKVYACEVTHQGLSSPVTKSFNRG EC |

| Sequence listing | |
|---|---|
| SEQ ID NO: 326 - BEAT EGFRpani-rnaxgraft/CD3(SP34-Kappa2) antibody FAB heavy chain (anti-EGFR panitumumab maxgraft FAB arm with G65S substitution BT33 LALA) | EVQLVESGGGLVQPGGSLRLSCAVSGGSVSSGDYYMSWVRQ APGKGLEWIGAIYYSGNTYYADSVKSRLTISIDTSKNTFYLQM NSLRAEDTAVYYCVRDRVTGAFDIWGQGTLVTVSSASTKGPS VFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTL MISRTPEVTCVVVDVSHEDPEVQFKWYVDGVEVHNAKTKPR EEQYNSTFRVVSVLTVLHQDWLNGKEYKCKVSNKALPAPIE KTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 327 - BEAT EGFRpani-maxgraft/CD3(SP34-Kappa2) antibody FAB light chain (anti-EGFR panitumumab maxgraft FAB arm) | DIQMTQSPSSLSASVGDRVTITCQASQDISNYLNWYQQKPGK APKLLIYDASNLETGVPSRFSGSGSGTDFTFTISSLQPEDIATYF CQHFDHLPLAFGGGTKVEIKRTVAAPSVFIFPPSDEQLKSGTA SVVCLLNNFYPREAKVQWKVDNALQSGNSQESVTEQDSKDS TYSLSSTLTLSKADYEKHKVYACEVTHQGLSSPVTKSFNRGE C |
| SEQ ID NO: 328 - BEAT EGFRpani-min graft/CD3(SP34-Kappa2) antibody FAB heavy chain (anti-EGFR panitumumab mingraft FAB arm with G65S substitution BT33 LALA) | EVQLVESGGGLVQPGGSLRLSCAASGGSVSSGDYYMSWVRQ APGKGLEWVSAIYYSGNTYYADSVKSRFTISRDNSKNTLYLQ MNSLRAEDTAVYYCVRDRVTGAFDIWGQGTLVTVSSASTKG PSVFPLAPSSKSTSGGTAALGCLVKDYFPEPVTVSWNSGALTS GVHTFPAVLQSSGLYSLSSVVTVPSSSLGTQTYICNVNHKPSN TKVDKKVEPKSCDKTHTCPPCPAPEAAGGPSVFLFPPKPKDTL MISRTPEVTCVVVDVSHEDPEVQFKWYVDGVEVHNAKTKPR EEQYNSTFRVVSVLTVLHQDWLNGKEYKCKVSNKALPAPIE KTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 329 - BEAT EGFRpani-mingraft/CD3(SP34-Kappa2) antibody FAB light chain (anti-EGFR panitumumab mingraft FAB arm) | DIQMTQSPSSLSASVGDRVTITCRASQDISNYLNWYQQKPGK APKLLIYDASSLQSGVPSRFSGSGSGTDFTLTISSLQPEDFATY YCQHFDHLPLAFGQGTKVEIKRTVAAPSVFIFPPSDEQLKSGT ASVVCLLNNFYPREAKVQWKVDNALQSGNSQESVTEQDSKD STYSLSSTLTLSKADYEKHKVYACEVTHQGLSSPVTKSFNRG EC |
| SEQ ID NO: 330 - BEAT CD19/CD3(SP34-Kappa2) antibody FAB heavy chain (anti-CD19 FAB arm with G65S substitution BT33 LALA) | QVQLVQSGGGVVQPGRSLRLSCAASGVSLPDYGVSWVRQAP GKGLEWVAVIWGSETTYYNSALKSRFTISRDNSKNTLYLQM NSLRAEDTAVYYCAKHYYYGGSYAMDYWGQGTLVTVSSAS TKGPSVFPLAPSSKSTSGGTAALGCLVKDYFPEPVTVSWNSG ALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVQFKWYVDGVEVHNAK TKPREEQYNSTFRVVSVLTVLHQDWLNGKEYKCKVSNKALP APIEKTISKTKGQPREPAVYTLPPSREEMTKNQVKLVCLVTGF YPSDIAVEWESSGQPENNYYTTPPMLDSDGSFSLVSWLNVDK SRWQQGNIFSCSVMHEALHNRFTQKSLSLSPG |
| SEQ ID NO: 331 - BEAT CD19/CD3(SP34-Kappa2) antibody FAB tight chain (anti-CD19 FAB arm) | DIQMTQSPSSLSASVGDRVTITCRASQDISKYLNWYQQKPGK AIKLLIYHTSRLHSGVPSRFSGSGSGTDFTLTISSLQPEDFATYY CQQGATLPYTFGPGTKVDIKRTVAAPSVFIFPPSDEQLKSGTA SVVCLLNNFYPREAKVQWKVDNALQSGNSQESVTEQDSKDS TYSLSSTLTLSKADYEKHKVYACEVTHQGLSSPVTKSFNRGE C |
| SEQ ID NO: 332 - BEAT IgEomali-maxgraft/CD3(SP34-Kappa2) antibody FAB heavy chain (anti-IgE omalizumab maxgraft FAB arm with G65S substitution BT33 LALA) | EVQLVESGGGLVQPGGSLRLSCAVSGYSITSGYSWNWIRQAP GKGLEWVASITYDGSTNYADSVKSRFTISRDDSKNTFYLQMN SLRAEDTAVYYCARGSHYFGHWHFAVWGQGTLVTVSSAST KGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPEAAGGPSVFLFPPKPK DTMISRTPEVTCVVVDVSHEDPEVQFKWYVDGVEVHNAKT KPREEQYNSTFRVVSVLTVLHQDWLNGKEYKCKVSNKALPA PIEKTISKTKGQPREPAVYTLPPSREEMTKNQVKLVCLVTGFY PSDIAVEWESSGQPENNYYTTPPMLDSDGSFSLVSWLNVDKS RWQQGNIFSCSVMHEALHNRFTQKSLSLSPG |
| SEQ ID NO: 333 - BEAT Ighomali-maxgraft/CD3(SP34- | DIQLTQSPSSLSASVGDRVTITCRASQSVDYDGDSYMNWYQQ KPGKAPKLLIYAASYLESGVPSRFSGSGSGTDFTLTISSLQPED FATYYCQQSHEDPYTFGQGTKVEIKRTVAAPSVFIFPPSDEQL |

Sequence listing

| | |
|---|---|
| Kappa2) antibody FAB light chain (anti-IgE omalizumab maxgraft FAB arm) | KSGTASVVCLLNNFVPREAKVQWKVDNALQSGNSQESVTEQ DSKDSTYSLSSTLTLSKADYEKHKVYACEVTHQGLSSPVTKS FNRGEC |
| SEQ ID NO: 334 - BEAT IgEomali-mingraft/CD3(SP34 - Kappa2) antibody FAB heavy chain (anti-IgE omalizumab mingraft FAB arm with G65S substitution BT33 LALA) | EVQLVESGGGLVQPGGSLRLSCAASGYSITSGYSMSWVRQAP GKGLEWVSAITYDGSTYYADSVKSRFTISRDNSKNTLYLQMN SLRAEDTAVYYCARGSHYFGHWHFAVWGQGTLVTVSSAST KGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPEAAGGPSVFLFPPKPK DTLMISRTPEVTCVVVDVSHEDPEVQFKWYVDGVEVHNAKT KPREEQYNSTFRVVSVLTVLHQDWLNGKEYKCKVSNKALPA PIEKTISKTKGQPREPAVYTLPPSREEMTKNQVKLVCLVTGFY PSDIAVEWESSGQPENNYYTTPPMLDSDGSFSLVSWLNVDKS RWQQGNIFSCSVMHEALHNRFTQKSLSLSPG |
| SEQ ID NO: 335 - BEAT IgEomali-mingraft/CD3(ISP34-Kappa2) antibody FAB light chain (anti-IgE omalizumab mingraft FAB arm) | DIQMTQSPSSLSASVGDRVTITCRASQSVDYDGDSYLNWYQQ KPGKAPKLLIYAASSLQSGVPSRFSGSGSGTDFTLTISSLQPED FATYYCQQSHEDPYTFGQGTKVEIKRTVAAPSVFIFPPSDEQL KSGTASVVCLLNNFYPREAKVQWKVDNALQSGNSQESVTEQ DSKDSTYSLSSTLTLSKADYEKHKVYACEVTHQGLSSPVTKS FNRGEC |
| SEQ ID NO: 336 - BEAT IgEbsw17-maxgraft/CD3 (SP34-Kappa2) antibody FAB heavy chain (anti-IgE omalizumab maxgraft FAB arm with G65S substitution BT33 LALA) | EVQLVESGGGLNIKPGGSLRLSCANTSGFTESSYAMS\VVRQAP GKGLEWVASISSGNIIYYPDNVKSRFTISRDNAKNSLYLQMNS LRAEDIAVYNCTRGRSTYGGEDI-IWGQGTTVTVSSASTKGPS VFPLAPSSKSTSGGTAALGCLVKDYFPEPVTVSWNSGALTSG -VITITPAVLQSSGLYSLSSVVTVPSSSLGTQ717YICNVN-HKPSNT KVDKKVEPKSCDKTFITCPPCPAPEAAGGPSVFLFPPKPKDTL MISRTPEVTCVVVDV SHEDPEVQFKWYVDGVEVHNAKTKPR EEQYNS7ITRVVSVLTVLILFIQD WINGKEYKCKVSNKALPAP 1E KTISKTKGQPREPAVYTLPPSREEMTKNQVKINCINTGFYPS DIAVENVESSGQPENN't'YTT:PPMLDSDGSFSLVSWLNVDKSR WQQGNIFSCSVMHEALFINRFTQKS LSI SPG |
| SEQ ID NO: 337 - BEAT IgEbsw17-maxgraft/CD3 (SP34-Kappa2) antibody FAB light chain (anti-IgE omalizumab maxgraft FAB arm) | DLQ Nill'QSPSS ISA S V GDR:VrIII FLN WYQQVGKA PWLLIYDTSSLQSGVPSRFSGSGSGTDYTLTISSMQPEDFATYY CQFIWSGNPLIFGQGTKVEIKKr VAAPSVFIFITSDEQLKSGTA SVVCIANNFYPREAKVQWKVDNALQSGNSQESVTEQDSKDS TYSLSSTLTLSKADYEKHKVYACEVTHQGLSSPVTKSFNRGE C |
| SEQ ID NO: 338 - BEAT IgEbsw17-mingraft/CD3 (SP34-Kappa2) antibody FAB heavy chain (anti-IgE omalizumab mingraft FAB arm with G65S substitution BT33 LALA) | EVQLVESGGGLVQPGGSLRLSCAASGFTSSYAMSWVRQAP GKGLEWVSAISSGNIIYYADSVKSRFTISRDNSKNTLYLQMNS LRAEDTAVYYCTRGRSTYGGFDHWGQGTLVTVSSASTKGPS VFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTL MISRTPEVTCVVVDVSHEDPEVQFKWYVDGVEVHNAKTKPR EEQYNSTFRVVSVLTVLHQDWLNGKEYKCKVSNKALPAPIE KTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 339 - BEAT IgEbsw17-mingraft/CD3 (SP34-Kappa2) antibody FAB tight chain (anti-IgE omalizumab mingraft FAB arm) | DIQMTQSPSSLSASVGDRVITCRASSSVTFLNWYQQKPGKAP KLLIYDTSSLQSGVPSRFSGSGSGTDFTLTISSLQPEDFATYYC QHWSGNPLTFGQGTKVEIKRTVAAPSVFIFPPSDEQLKSGTAS VVCLLNNFYPREAKVQWKVDNALQSGNSQESVTEQDSKDST YSLSSTLTLSKADYEKHKVYACEVTHQGLSSPVTKSFNRGEC |
| SEQ ID NO: 340 - BEAT OX40/CD3(SP34-Kappa2) antibody FAB heavy chain (anti-OX40 1D4 FAB arm BT33 LALA) | QVTLKESGPALVKPTQTLTLTCSFSGESLSTSGMGVGWIRQPP GKALEWIAHIWWDDDKYYNTALKTRLTISKDTSKNQVVLTM TNMDPVDTATYYCARIDWDGFAYWGQGTLVTVSSASTKGPS VFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTL MISRTPEVTCVVVDVSHEDPEVQFKWYVDGVEVHNAKTKPR EEQYNSTFRVVSVLTVLHQDWLNGKEYKCKVSNKALPAPIE KTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |

-continued

| Sequence listing | |
|---|---|
| SEQ ID NO: 341 - BEAT CD20/CD3(SP34-Kappa2) antibody FAB heavy chain (anti-CD20 rituximab FAB arm BT33 LALA) | QVQLQQPGAELVKPGASVKMSCKASGYTFTSYNMHWVKQT PGRGLEWIGAIYPGNGDTSYNQKFKGKATLTADKSSSTAYM QLSSLTSEDSAVYYCARSTYYGGDWYFNVWGAGTTVTVSAA STKGPSVFPLAPSSKSTSGGTAALGCLVKDYFPEPVTVSWNSG ALTSGVHTFPAVLQSSGLYSLSSVVTVPSSSLGTQTYICNVNH KPSNTKVDKKVEPKSCDKTHTCPPCPAPEAAGGPSVFLFPPKP KDTLMISRTPEVTCVVVDVSHEDPEVQFKWYVDGVEVHNAK TKPREEQYNSTFRVVSVLTVLHQDWLNGKEYKCKVSNKALP APIEKTISTKGQPREPAVYTLPPSREEMTKNQVKLVCLVTGF YPSDIAVEWESSGQPENNYYTTPPMLDSDGSFSLVSWLNVDK SRWQQGNIFSCSVMHEALHNRFTQKSLSLSPG |
| SEQ ID NO: 342 - BEAT EGFRcetux/CD3(SP34-Kappa2) antibody FAB heavy chain (anti-EGFR cetuximab FAB arm BT33 LALA) | QVQLKQSGPGLVQPSQSLSITCTVSGFSLTNYGVHWVRQSPG KGLEWLGVIWSGGNTDYNTPFTSRLSINKDNSKSQVFFKMNS LQSNDTAIYYCARALTYYDYEFAYWGQGTLVTVSAASTKGP SVFPLAPSSKSTSGGTAALGCLVKDYFPEPVTVSWNSGALTSG VHTFPAVLQSSGLYSLSSVVTVPSSSLGTQTYICNVNHKPSNT KVDKKVEPKSCDKTHTCPPCPAPEAAGGPSVFLFPPKPKDTL MISRTPEVTCVVVDVSHEDPEVQFKWYVDGVEVHNAKTKPR EEQYNSTFRSVVSVLTVLHQDWLNGKEYKCKVSNKALPAPIE KTISKTKGQPREPAVYTLPPSREEMTKNQVKLVCLVTGFYPS DIAVEWESSGQPENNYYTTPPMLDSDGSFSLVSWLNVDKSR WQQGNIFSCSVMHEALHNRFTQKSLSLSPG |
| SEQ ID NO: 343 - BEAT EGFRpani/CD3(SP34-Kappa2) antibody FAB heavy chain (anti-EGFR panitumumab FAB arm BT33 LALA) | QVQLQESGPGLVKPSETLSLTCTVSGGSVSSGDYYWTWIRQS PGKGLEWIGHIYYSGNTNYNPSLKSRLTISIDTSKTQFSLKLSS VTAADTAIYYCVRDRVTGAFDIWGQGTMVTVSSASTKGPSV FPLAPSSKSTSGGTAALGCLVKDYFPEPVTVSWNSGALTSGV HTFPAVLQSSGLYSLSSVVTVPSSSLGTQTYICNVNHKPSNTK VDKKVEPKSCDKTHTCPPCPAPEAAGGPSVFLFPPKPKDTLMI SRTPEVTCVVVDVSHEDPEVQFKWYVDGVEVHNAKTKPREE QYNSTFRVVSVLTVLHQDWLNGKEYKCKVSNKALPAPIEKTI SKTKGQPREPAVYTLPPSREEMTKNQVKLVCLVTGFYPSDIA VEWESSGQPENNYYTTPPMLDSDGSFSLVSWLNVDKSRWQQ GNIFSCSVMHEALHNRFTQKSLSLSPG |
| SEQ ID NO: 344 - BEAT EGFRpani/CD3(SP34-Kappa2) antibody FAB light chain (anti-EGFR panitumumab FAB arm) | DIQMTQSPSSLSASVGDRVTITCQASQDISNYLNWYQQKPGK APKLLIYDASNLETGVPSRFSGSGSGTDFTFTISSLQPEDIATYF CQHFDHLPLAFGGGTKVEIKRTVAAPSVFIFPPSDEQLKSGTA SVVCLLNNFYPREAKVQWKVDNALQSGNSQESVTEQDSKDS TYSLSSTLTLSKADYEKHKVYACEVTHQGLSSPVTKSFNRGE C |
| SEQ ID NO: 345 - BEAT IgEomali/CD3(SP34-Kappa2) antibody FAB heavy chain (anti-IgE omalizumab FAB arm BT33 LALA) | EVQLVESGGGLVQPGGSLRLSCAVSGYSITSGYSWNWIRQAP GKGLEWVASITYDGSTNYADSVKGRFTISRDDSKNTFYLQMN SLRAEDTAVYYCARGSHYFGHWHFAVWGQGTLVTVSSAST KGPSVFPLAPSSKSTSGGTAALGCLVKDYFPEPVTVSWNSGA LTSGVHTFPAVLQSSGLYSLSSVVTVPSSSLGTQTYICNVNHK PSNTKVDKKVEPKSCDKTHTCPPCPAPEAAGGPSVFLFPPKPK DTLMISRTPEVTCVVVDVSHEDPEVQFKWYVDGVEVHNAKT KPREEQYNSTFRVVSVLTVLHQDWLNGKEYKCKVSNKALPA PIEKTISKTKGQPREPAVYTLPPSREEMTKNQVKLVCLVTGFY PSDIAVEWESSGQPENNYYTTPPMLDSDGSFSLVSWLNVDKS RWQQGNIFSCSVMHEALHNRFTQKSLSLSPG |
| SEQ ID NO: 346 - BEAT IgEomali/CD3(SP34-Kappa2) antibody FAB light chain (anti-IgE omalizumab FAB arm) | DIQLTQSPSSLSASVGDRVTITCRASQSVDYDGDSYMNWYQQ KPGKAPKLLIYAASYLESGVPSRFSGSGSGTDFTLTISSLQPED FATYYCQQSHEDPYTFGQGTKVEIKRTVAAPSVFIFPPSDEQL KSGTASVVCLLNNFYPREAKVQWKVDNALQSGNSQESVTEQ DSKDSTYSLSSTLTLSKADYEKHKVYACEVTHQGLSSPVTKS FNRGEC |
| SEQ ID NO: 347 - BEAT IgEbsw17/CD3(SP34-Kappa2) antibody FAB heavy chain (anti-IgE Bsw17 FAB arm BT33 LALA) | EVQLLESGGGFVKPGGSLKLSCVVSGFTFSSYAMSWVRQTPE KRLEWVASISSGNIIYYPDNVKGRFTISRDNVRNILYLQMSSL RSEDTAMYYCTRGRSTYGGFDHWGQGTTLTVSSASTKGPSV FPLAPSSKSTSGGTAALGCLVKDYFPEPVTVSWNSGALTSGV HTFPAVLQSSGLYSLSSVVTVPSSSLGTQTYICNVNHKPSNTK VDKKVEPKSCDKTHTCPPCPAPEAAGGPSVFLFPPKPKDTLMI SRTPEVTCVVVDVSHEDPEVQFKWYVDGVEVHNAKTKPREE QYNSTFRVVSVLTVLHQDWLNGKEYKCKVSNKALPAPIEKTI SKTKGQPREPAVYTLPPSREEMTKNQVKLVCLVTGFYPSDIA VEWESSGQPENNYYTTPPMLDSDGSFSLVSWLNVDKSRWQQ GNIFSCSVMHEALHNRFTQKSLSLSPG |

| Sequence listing | |
|---|---|
| SEQ ID NO: 348 - BEAT IgEbsw17/CD3(SP34-Kappa2) antibody FAB light chain (anti-IgE Bsw17 FAB arm) | ELVMTQSPAIMSASPGEKVTMTCSASSSVTFIHWYRQKSGTSP KGWIYDTSKLASGVPARFSGSGSGTSYSLTISTMEAEDAATY YCQHWSGNPLTFGTGTKLELKRTVAAPSVFIFPPSDEQLKSGT ASVVCLLNNFYPREAKVQWKVDNALQSGNSQESVTEQDSKD STYSLSSTLTLSKADYEKHKVYACEVTHQGLSSPVTKSFNRG EC |
| SEQ ID NO: 349 - scFv fragment humanized SP34 VH1-VL24 - human IgG1 Fc fusion | EVQLVESGGGLVQPGGSLRLSCAASGFTFNTYAMNWVRQAP GKGLEWVARIRSKYNNYATYYADSVKGRFTISRDDSKNTLY LQMSLRAEDTAVYYCVRHGNFGNSYNTSWFAYWGQGTTVT VSSGGGGSGGGGSGGGGSEIVVTQSPATLSVSPGERATLSCRS SAAAVTTSNYANWVQEKPGQAFRGLIGGANKRAPGVPARFS GSLSGDEATLTISSLQSEDFAVYYCALWYSNLWVFGQGTKLE IKGGGGTDKTHTCPPCPAPELLGGPSVFLFPPKPKDTLMISRTP EVTCVVVDVSHEDPEVKFNWYVDGVEVHNAKTKPREEQYN STYRVVSVLTVLHQDWLNGKEYKCKVSNKALPAPIEKTISKA KGQPREPQVYTLPPSRDELTKNQVSLTCLVKGFYPSDIAVEW ESNGQPENNYKTTPPVLDSDGSFFLYSKLTVDKSRWQQGNVF SCSVMHEALHNHYTQKSLSLSPGK |
| SEQ ID NO: 350 - scFv fragment humanized SP34 VH1-VL25 - human IgG1 Fc fusion | EVQLVESGGGLVQPGGSLRLSCAASGFTFNTYAMNWVRQAP GKGLEWVARIRSKYNNYATYYADSVKGRFTISRDDSKNTLY LQMNSLRAEDTAVYYCVRHGNFGNSYVSWFAYWGQGTTVT VSSGGGGSGGGGSGGGGSEIVVTQSPATILSVSPGERATLSCRS STGAAATSNYANWVQEKPGQAFRGLIGGANKRAPGVPARFS GSLSGDEATLTISSLQSEDFAVYYCALWYSNLWVFGQGTKLE IKGGGGTDKTHTCPPCPAPELLGGPSVFLFPPKPKDTLMISRTP EVTCVVVDVSHEDPEVKFNWYVDGVEVHNAKTKPREEQYN STYRVVSVLTVLHQDWLNGKEYKCKVSNKALPAPIEKTISKA KGQPREPQVYTLPPSRDELTKNQVSLTCLVKGFYPSDIAVEW ESNGQPENNYKTTPPVLDSDGSFFLYSKLTVDKSRWQQGNVF SCSVMHEALHNHYTQKSLSLSPGK |
| SEQ ID NO: 351 - scFv fragment humanized SP34 VH1-VL26 - human IgG1 Fc fusion | EVQLVESGGGLVQPGGSLRLSCAASGFTFNTYAMNWVRQAP GKGLEWVARIRSKYNNYATYYADSVKGRFTISRDDSKNTLY LQMNSLRAEDTAVYYCVRHGNFGNSYVSWFAYWGQGTTVT VSSGGGGSGGGGSGGGGSEIVVTQSPATLSVSPGERATLSCRS STGAVTAANYANWVQEKPGQAFRGLIGGANKRAPGVPARFS GSLSGDEATLTISSLQSEDFAVYYCALWYSNLWVFGQGTKLE IKGGGGTDKTHTCPPCPAPELLGGPSVFLFRPKPKDTLMISRTP EVTCVVVDVSHEDPEVKFNWYVDGVEVHNAKTKPREEQYN STYRVVSVLTVLHQDWLNGKEYKCKVSNKALPAPIEKTISKA KGQPREPQVYTLPPSRDELTKNQVSLTCLVKGFYPSDIAVEW ESNGQPENNYKTTPPVLDSDGSFFLYSKLTVDKSRWQQGNVF SCSVMHEALHNHYTQKSLSLSPGK |
| SEQ ID NO: 352 - Humanized anti- human CD3 epsilon SP34 VH5 CDR H1 | GFTFNTYA |
| SEQ ID NO: 353 - Humanized anti- human CD3 epsilon SP34 VH5 CDR H2 | IRSKYNNYAT |
| SEQ ID NO: 354 - Humanized anti- human CD3 epsilon SP34 VH5 CDR H3 | VRHGNFGNSYVSYFAY |
| SEQ ID NO: 355 - Humanized anti- human CD3 epsilon SP34 VL32 CDR L1 | TGAVTAANY |
| SEQ ID NO: 356 - Humanized anti- human CD3 epsilon SP34 VL32 CDR L2 | GAN |
| SEQ ID NO: 357 - Humanized anti- human CD3 epsilon SP34 VL32 CDR L3 | ALFYSNLWV |

| | |
|---|---|
| SEQ ID NO: 358 -<br>OKT3 humanized VH9<br>domain | EVQLVESGGGLVQPGGSLRLSCAASGYTFTRYTMHWVRQAP<br>GKGLEWIGYINPSRGYTYYADSVKSRFTLSTDKSKNTAYLQM<br>NSLRAEDTAVYYCARYYDDHYCLDYWGQGTLVTVSS |
| SEQ ID NO: 359 -<br>SP34 humanized IgG1<br>heavy chain with VH5 | EVQLVESGGGLVQPGGSLRLSCAASGFTFNTYAMNWVRQAP<br>GKGLEWVARIRSKYNNYATYYADSVKGRFTISRDDSKNTLY<br>LQMNSLRAEDTAVYYCVRHGNFGNSYVSYFAYWGQGTTVT<br>VSSASTKGPSVFPLAPSSKSTSGGTAALGCLVKDYFPEPVTVS<br>WNSGALTSGVHTFPAVLQSSGLYSLSSVVTVPSSSLGTQTYIC<br>NVNHKPSNTKVDKKVEPKSCDKTHTCPPCPAPELLGGPSVFL<br>FPPKPKDTLMISRTPEVTCVVVDVSHEDPEVKFNWYVDGVEV<br>HNAKTKPREEQYNSTYRVVSVLTVLHQDWLNGKEYKCKVS<br>NKALPAPIEKTISKAKGQPREPQVYTLPPSREEMTKNQVSLTC<br>LVKGFYPSDIAVEWESNGQPENNYKTTPPVLDSDGSFFLYSKL<br>TVDKSRWQQGNVFSCSVMHEALHNHYTQKSLSLSPGK |
| SEQ ID NO: 360 -<br>SP34 humanized Light<br>chain with VL32 | EIVVTQSPATLSVSPGERATLSCRSSTGAVTAANYANWVQEK<br>PGQAFRGLIGGANKRAPGVPARFSGSLSGDEATLTISSLQSED<br>FAVYYCALFYSNLWVFGQGTKLEIKKRTVAAPSVFIFPPSDEQ<br>LKSGTASVVCLLNNFYPREAKVQWKVDNALQSGNSQESVTE<br>QDSKDSTYSLSSTLTLSKADYEKHKVYACEVTHQGLSSPVTK<br>SFNRGEC |

SEQUENCE LISTING (367 sequences)

SEQ ID NO: 1 - protein, 227 aa, Artificial Sequence
  SEQ ID NO: 1 - Fc 133
DKTHTCPPCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 2 - protein, 450 aa, Artificial Sequence
  SEQ ID NO: 2 - anti-HER2 FAB-Fc 133 heavy chain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 3 - protein, 214 aa, Artificial Sequence
  SEQ ID NO: 3 - anti-HER2 light chain
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4 - protein, 475 aa, Artificial Sequence
  SEQ ID NO: 4 - anti-HER2 scFv-Fc 133
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSTVPSRFSGSRSGTDFTLTISSLQPEDFATYYCQQHYTTPPTFGQGTKVEIKRGGGGTDKTHTCPPCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 5 - protein, 223 aa, Artificial Sequence
  SEQ ID NO: 5 - anti-HER2 FAB heavy chain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 6 - protein, 223 aa, Artificial Sequence
  SEQ ID NO: 6 - anti-HER2 FAB G65S heavy chain
EVQLVESGGGLVQPGGSLRLSCAASGFNIKDTYIHWVRQAPGKGLEWVARIYPTNGYTRYADSVKSRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7 - protein, 223 aa, Artificial Sequence
  SEQ ID NO: 7 - anti-HER2 FAB R66Q heavy chain
EVQLVESGGGLVQPGGSLRLSCAASGFNIKDTYIHWVRQAPGKGLEWVARIYPTNGYTRYADSVKGQFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8 - protein, 223 aa, Artificial Sequence
  SEQ ID NO: 8 - anti-HER2 FAB T68V heavy chain
EVQLVESGGGLVQPGGSLRLSCAASGFNIKDTYIHWVRQAPGKGLEWVARIYPTNGYTRYADSVKGRFVISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 9 - protein, 223 aa, Artificial Sequence
  SEQ ID NO: 9 - anti-HER2 FAB Q81E heavy chain
EVQLVESGGGLVQPGGSLRLSCAASGFNIKDTYIHWVRQAPGKGLEWVARIYPTNGYTRYADSVKGRFTISADTSKNTAYLEMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10 - protein, 223 aa, Artificial Sequence
  SEQ ID NO: 10 - anti-HER2 FAB N82aS heavy chain
EVQLVESGGGLVQPGGSLRLSCAASGFNIKDTYIHWVRQAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 11 - protein, 223 aa, Artificial Sequence
  SEQ ID NO: 11 - anti-HER2 FAB R19G/T57A/Y59A heavy chain
EVQLVESGGGLVQPGGSLGLSCAASGFNIKDTYIHWVRQAPGKGLEWVARIYPTNGYARAADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 12 - protein, 223 aa, Artificial Sequence
  SEQ ID NO: 12 - anti-HER2 FAB T57A heavy chain
EVQLVESGGGLVQPGGSLRLSCAASGFNIKDTYIHWVRQAPGKGLEWVARIYPTNGYARYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 13 - protein, 223 aa, Artificial Sequence
  SEQ ID NO: 13 - anti-HER2 FAB T57E heavy chain
EVQLVESGGGLVQPGGSLRLSCAASGFNIKDTYIHWVRQAPGKGLEWVARIYPTNGYERYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 14 - protein, 475 aa, Artificial Sequence
  SEQ ID NO: 14 - anti-HER2 scFv(G65S)-Fc 133 heavy chain
EVQLVESGGGLVQPGGSLRLSCAASGFNIKDTYIHWVRQAPGKGLEWVARIYPTNGYTRYADSVKSRFTISADTSKNTAYLQMNSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSTVPSRFSGSRSGTDFTLTISSLQPEDFATYYCQQHYTTPPTFGQGTKVEIKRGGGGTDKTHTCPPCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 15 - protein, 475 aa, Artificial Sequence
  SEQ ID NO: 15 - anti-HER2 scFv(N82aS)-Fc 133 heavy chain
EVQLVESGGGLVQPGGSLRLSCAASGFNIKDTYIHWVRQAPGKGLEWVARIYPTNGYTRYADSVKGRFTISADTSKNTAYLQMSSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSTVPSRFSGSRSGTDFTLTISSLQPEDFATYYCQQHYTTPPTFGQGTKVEIKRGGGGTDKTHTCPPCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 16 - protein, 450 aa, Artificial Sequence
  SEQ ID NO: 16 - anti-HER2 FAB(G65S)-Fc 133 heavy chain
EVQLVESGGGLVQPGGSLRLSCAASGFNIKDTYIHWVRQAPGKGLEWVARIYPTNGYTRYADSVKSRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 17 - protein, 450 aa, Artificial Sequence
  SEQ ID NO: 17 - anti-HER2 FAB(N82aS)-Fc 133 heavy chain
EVQLVESGGGLVQPGGSLRLSCAASGFNIKDTYIHWVRQAPGKGLEWVARIYPTNGYTRYADSVKGRFTISADTSKNTAYLQMSSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 18 - protein, 119 aa, Artificial Sequence [sequence omitted]

SEQ ID NO: 19 - protein, 106 aa, Artificial Sequence [sequence omitted]

SEQ ID NO: 20 - protein, 120 aa, Artificial Sequence [sequence omitted]

SEQ ID NO: 21 - protein, 107 aa, Artificial Sequence [sequence omitted]

SEQ ID NO: 22 - protein, 98 aa, Homo sapiens
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 23 - protein, 95 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTP

SEQ ID NO: 24 - protein, 96 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSP

SEQ ID NO: 25 - protein, 449 aa, Artificial Sequence
  SEQ ID NO: 25 - Chimeric OKT3 heavy chain IgG1
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 26 - protein, 213 aa, Artificial Sequence
  SEQ ID NO: 26 - Chimeric OKT3 human kappa light chain
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27 - protein, 449 aa, Artificial Sequence
  SEQ ID NO: 27 - OKT3 humanized heavy chain with VH domain
EVQLVESGGGLVQPGGSLRLSCAASGYTFTRYTIHWVRQAPGKGLEWVAYINPSRGYTRYADSVKGRFTISADTSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - protein, 449 aa, Artificial Sequence
  SEQ ID NO: 28 - OKT3 humanized heavy chain with VH1 domain
EVQLVESGGGLVQPGGSLRLSCAASGYTFTRYTIHWVRQAPGKGLEWVGYINPSRGYTRYADSVKGRFTISADTSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29 - protein, 449 aa, Artificial Sequence
  SEQ ID NO: 29 - OKT3 humanized heavy chain with VH2 domain
EVQLVESGGGLVQPGGSLRLSCAASGYTFTRYTMHWVRQAPGKGLEWVGYINPSRGYTRYADSVKGRFTISADTSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 449 aa, Artificial Sequence
  SEQ ID NO: 30 - OKT3 humanized heavy chain with VH3 domain
EVQLVESGGGLVQPGGSLRLSCAASGYTFTRYTIHWVRQAPGKGLEWVGYINPSRGYTRYADSVKGRFTISTDTSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 31 - protein, 449 aa, Artificial Sequence
  SEQ ID NO: 31 - OKT3 humanized heavy chain with VH4 domain
EVQLVESGGGLVQPGGSLRLSCAASGYTFTRYTMHWVRQAPGKGLEWVGYINPSRGYTRYADSVKGRFTISTDTSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 449 aa, Artificial Sequence
  SEQ ID NO: 32 - OKT3 humanized heavy chain with VH5 domain
EVQLVESGGGLVQPGGSLRLSCAASGYTFTRYTMHWVRQAPGKGLEWVGYINPSRGYTRYADSVKGRFTLSTDKSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 33 - protein, 449 aa, Artificial Sequence
  SEQ ID NO: 33 - OKT3 humanized heavy chain with VH6 domain
EVQLVESGGGLVQPGGSLRLSCAASGYTFTRYTMHWVRQAPGKGLEWIGYINPSRGYTRYADSVKGRFTLSTDKSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 449 aa, Artificial Sequence
  SEQ ID NO: 34 - OKT3 humanized heavy chain with VH7 domain
EVQLVESGGGLVQPGGSLRLSCAASGYTFTRYTMHWVRQAPGKGLEWVGYINPSRGYTNYADSVKGRFTLSTDKSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 35 - protein, 449 aa, Artificial Sequence
  SEQ ID NO: 35 - OKT3 humanized heavy chain with VH8 domain
EVQLVESGGGLVQPGGSLRLSCAASGYTFTRYTMHWVRQAPGKGLEWIGYINPSRGYTYYADSVKGRFTLSTDKSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 449 aa, Artificial Sequence
  SEQ ID NO: 36 - OKT3 humanized heavy chain with VH9 domain
EVQLVESGGGLVQPGGSLRLSCAASGYTFTRYTMHWVRQAPGKGLEWIGYINPSRGYTYYADSVKSRFTLSTDKSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 37 - protein, 449 aa, Artificial Sequence
  SEQ ID NO: 37 - OKT3 humanized heavy chain with VH10 domain
EVQLVESGGGLVQPGGSLRLSCAASGYTFTRYTMHWVRQAPGKGLEWIGYINPSRGYTYYADSVKSRATLSTDKSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 449 aa, Artificial Sequence
  SEQ ID NO: 38 - OKT3 humanized heavy chain with VH11 domain
EVQLVESGGGLVQPGGSLRLSCAASGYTFTRYTMHWVRQAPGKGLEWIGYINPSRGYTYYADSVKGRFTLSTDKSKNTAYLQMSSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - protein, 213 aa, Artificial Sequence
  SEQ ID NO: 39 - OKT3 humanized light chain with VL domain
DIQMTQSPSSLSASVGDRVTITCRASSSVSYVAWYQQKPGKAPKLLIYDTSKLYSGVPSRFSGSRSGTDFTLTISSLQPEDFATYYCQQWSSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 213 aa, Artificial Sequence
  SEQ ID NO: 40 - OKT3 humanized light chain with VL1 domain
DIQMTQSPSSLSASVGDRVTITCRASSSVSYVAWYQQKPGKAPKLLIYDTSKLYSGVPSRFSGSRSGTDYTLTISSLQPEDFATYYCQQWSSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 213 aa, Artificial Sequence
  SEQ ID NO: 41 - OKT3 humanized light chain with VL2 domain
DIQLTQSPSSLSASVGDRVTITCRASSSVSYVAWYQQKPGKAPKLLIYDTSKLYSGVPSRFSGSRSGTDFTLTISSLQPEDFATYYCQQWSSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42 - protein, 213 aa, Artificial Sequence
  SEQ ID NO: 42 - OKT3 humanized light chain with VL3 domain
DIQLTQSPSSLSASVGDRVTITCRASSSVSYVAWYQQKPGKAPKLLIYDTSKLYSGVPSRFSGSRSGTDYTLTISSLQPEDFATYYCQQWSSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 213 aa, Artificial Sequence
  SEQ ID NO: 43 - OKT3 humanized light chain with VL4 domain
DIQLTQSPSSLSASVGDRVTITCRASSSVSYVAWYQQKPGKAPKRWIYDTSKLYSGVPSRFSGSRSGTDYTLTISSLQPEDFATYYCQQWSSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 44 - protein, 213 aa, Artificial Sequence
  SEQ ID NO: 44 - OKT3 humanized light chain with VL5 domain
DIQLTQSPSSLSASVGDRVTITCRASSSVSYMNWYQQKPGKAPKLLIYDTSKLYSGVPSRFSGSRSGTDYTLTISSLQPEDFATYYCQQWSSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 213 aa, Artificial Sequence
  SEQ ID NO: 45 - OKT3 humanized light chain with VL6 domain
DIQLTQSPSSLSASVGDRVTITCRASSSVSYVAWYQQKPGKAPKRWIYDTSKLYSGVPSRFSGSRSGTDYTLTISSLQPEDFATYYCQQWSSNPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 46 - protein, 213 aa, Artificial Sequence
  SEQ ID NO: 46 - OKT3 humanized light chain with VL7 domain
DIQLTQSPSSLSASVGDRVTITCRASSSVSYMNWYQQKPGKAPKLLIYDTSKLYSGVPSRFSGSRSGTDYTLTISSLQPEDFATYYCQQWSSNPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - protein, 213 aa, Artificial Sequence
  SEQ ID NO: 47 - OKT3 humanized light chain with VL8 domain
DIQLTQSPSSLSASVGDRVTITCRASSSVSYVAWYQQKPGKAPKRWIYDTSKLYSGVPSRFSGSGSGTDYTLTISSLQPEDFATYYCQQWSSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 119 aa, Artificial Sequence
  SEQ ID NO: 48 - OKT3 humanized VH8 domain
EVQLVESGGGLVQPGGSLRLSCAASGYTFTRYTMHWVRQAPGKGLEWIGYINPSRGYTYYADSVKGRFTLSTDKSKNTAYLQMNSLRAEDTAVYYCARYYDDHYCLDYWGQGTLVTVSS

SEQ ID NO: 49 - protein, 119 aa, Artificial Sequence
  SEQ ID NO: 49 - OKT3 humanized VH11 domain
EVQLVESGGGLVQPGGSLRLSCAASGYTFTRYTMHWVRQAPGKGLEWIGYINPSRGYTYYADSVKGRFTLSTDKSKNTAYLQMSSLRAEDTAVYYCARYYDDHYCLDYWGQGTLVTVSS

SEQ ID NO: 50 - protein, 106 aa, Artificial Sequence
  SEQ ID NO: 50 - OKT3 humanized VL4 domain
DIQLTQSPSSLSASVGDRVTITCRASSSVSYVAWYQQKPGKAPKRWIYDTSKLYSGVPSRFSGSRSGTDYTLTISSLQPEDFATYYCQQWSSNPPTFGQGTKVEIK

SEQ ID NO: 51 - protein, 106 aa, Artificial Sequence
  SEQ ID NO: 51 - OKT3 humanized VL8 domain
DIQLTQSPSSLSASVGDRVTITCRASSSVSYVAWYQQKPGKAPKRWIYDTSKLYSGVPSRFSGSGSGTDYTLTISSLQPEDFATYYCQQWSSNPPTFGQGTKVEIK

SEQ ID NO: 52 - protein, 472 aa, Artificial Sequence
  SEQ ID NO: 52 - scFv fragment  mouse OKT3 - human IgG1 Fc fusion
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSGGGGSGGGGSGGGGSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 477 aa, Artificial Sequence
  SEQ ID NO: 53 - scFv fragment  humanized OKT3 VH5-VL3 - human IgG1 Fc fusion
EVQLVESGGGLVQPGGSLRLSCAASGYTFTRYTMHWVRQAPGKGLEWVGYINPSRGYTRYADSVKGRFTLSTDKSKNTAYLQMNSLRAEDTAVYYCARYYDDHYCLDYWGQGTLVTVSSGGGGSGGGGSGGGGSGGGASDIQLTQSPSSLSASVGDRVTITCRASSSVSYVAWYQQKPGKAPKLLIYDTSKLYSGVPSRFSGSRSGTDYTLTISSLQPEDFATYYCQQWSSNPPTFGQGTKVEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 54 - protein, 477 aa, Artificial Sequence
  SEQ ID NO: 54 - scFv fragment  humanized OKT3 VH6-VL4 - human IgG1 Fc fusion
EVQLVESGGGLVQPGGSLRLSCAASGYTFTRYTMHWVRQAPGKGLEWIGYINPSRGYTRYADSVKGRFTLSTDKSKNTAYLQMNSLRAEDTAVYYCARYYDDHYCLDYWGQGTLVTVSSGGGGSGGGGSGGGGSGGGASDIQLTQSPSSLSASVGDRVTITCRASSSVSYVAWYQQKPGKAPKRWIYDTSKLYSGVPSRFSGSRSGTDYTLTISSLQPEDFATYYCQQWSSNPPTFGQGTKVEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 477 aa, Artificial Sequence
  SEQ ID NO: 55 - scFv fragment  humanized OKT3 VH6-VL5 - human IgG1 Fc fusion
EVQLVESGGGLVQPGGSLRLSCAASGYTFTRYTMHWVRQAPGKGLEWIGYINPSRGYTRYADSVKGRFTLSTDKSKNTAYLQMNSLRAEDTAVYYCARYYDDHYCLDYWGQGTLVTVSSGGGGSGGGGSGGGGSGGGASDIQLTQSPSSLSASVGDRVTITCRASSSVSYMNWYQQKPGKAPKLLIYDTSKLYSGVPSRFSGSRSGTDYTLTISSLQPEDFATYYCQQWSSNPPTFGQGTKVEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 477 aa, Artificial Sequence
  SEQ ID NO: 56 - scFv fragment  humanized OKT3 VH8-VL4 - human IgG1 Fc fusion
EVQLVESGGGLVQPGGSLRLSCAASGYTFTRYTMHWVRQAPGKGLEWIGYINPSRGYTYYADSVKGRFTLSTDKSKNTAYLQMNSLRAEDTAVYYCARYYDDHYCLDYWGQGTLVTVSSGGGGSGGGGSGGGGSGGGASDIQLTQSPSSLSASVGDRVTITCRASSSVSYVAWYQQKPGKAPKRWIYDTSKLYSGVPSRFSGSRSGTDYTLTISSLQPEDFATYYCQQWSSNPPTFGQGTKVEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 477 aa, Artificial Sequence
  SEQ ID NO: 57 - scFv fragment  humanized OKT3 VH8-VL8 - human IgG1 Fc fusion
EVQLVESGGGLVQPGGSLRLSCAASGYTFTRYTMHWVRQAPGKGLEWIGYINPSRGYTYYADSVKGRFTLSTDKSKNTAYLQMNSLRAEDTAVYYCARYYDDHYCLDYWGQGTLVTVSSGGGGSGGGGSGGGGSGGGASDIQLTQSPSSLSASVGDRVTITCRASSSVSYVAWYQQKPGKAPKRWIYDTSKLYSGVPSRFSGSGSGTDYTLTISSLQPEDFATYYCQQWSSNPPTFGQGTKVEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 245 aa, Artificial Sequence
  SEQ ID NO: 58 - scFv fragment  humanized OKT3 VH8-VL4
EVQLVESGGGLVQPGGSLRLSCAASGYTFTRYTMHWVRQAPGKGLEWIGYINPSRGYTYYADSVKGRFTLSTDKSKNTAYLQMNSLRAEDTAVYYCARYYDDHYCLDYWGQGTLVTVSSGGGGSGGGGSGGGGSGGGASDIQLTQSPSSLSASVGDRVTITCRASSSVSYVAWYQQKPGKAPKRWIYDTSKLYSGVPSRFSGSRSGTDYTLTISSLQPEDFATYYCQQWSSNPPTFGQGTKVEIK

SEQ ID NO: 59 - protein, 245 aa, Artificial Sequence
  SEQ ID NO: 59 - scFv fragment  humanized OKT3 VH8-VL8
EVQLVESGGGLVQPGGSLRLSCAASGYTFTRYTMHWVRQAPGKGLEWIGYINPSRGYTYYADSVKGRFTLSTDKSKNTAYLQMNSLRAEDTAVYYCARYYDDHYCLDYWGQGTLVTVSSGGGGSGGGGSGGGGSGGGASDIQLTQSPSSLSASVGDRVTITCRASSSVSYVAWYQQKPGKAPKRWIYDTSKLYSGVPSRFSGSGSGTDYTLTISSLQPEDFATYYCQQWSSNPPTFGQGTKVEIK

SEQ ID NO: 60 - protein, 125 aa, Artificial Sequence
  SEQ ID NO: 60 - Mouse anti-human CD3 epsilon SP34 VH domain
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 61 - protein, 109 aa, Artificial Sequence
  SEQ ID NO: 61 - Mouse anti-human CD3 epsilon SP34 VL domain
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 62 - protein, 455 aa, Artificial Sequence
  SEQ ID NO: 62 - Chimeric SP34 heavy chain IgG1
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 216 aa, Artificial Sequence
  SEQ ID NO: 63 - Chimeric SP34 light chain (mouse V lambda - human lambda constant domain)
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 64 - protein, 455 aa, Artificial Sequence
  SEQ ID NO: 64 - SP34 humanized heavy chain with VH1 domain
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 455 aa, Artificial Sequence
  SEQ ID NO: 65 - SP34 humanized heavy chain with VH2 domain
EVQLVESGGGLVQPGGSLRLSCAASGFTFNTYAMNWVRQAPGKGLEWVARIRSKYNNYATYYADSVKSRFTISRDDSKNTLYLQMNSLRAEDTAVYYCVRHGNFGNSYVSWFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 455 aa, Artificial Sequence
  SEQ ID NO: 66 - SP34 humanized heavy chain with VH3 domain
EVQLVESGGGLVQPGGSLRLSCAASGFTFNTYAMNWVRQAPGKGLEWVARIRSKYNNYATYYADSVKSRFTISRDDSKNTLYLQMNSLRAEDTAVYYCVRHGNFGNSYVSYFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 455 aa, Artificial Sequence
  SEQ ID NO: 67 - SP34 humanized heavy chain with VH4 domain
EVQLVESGGGLVQPGGSLRLSCAASGFTFNTYAMNWVRQAPGKGLEWVARIRSKYNNYATYYADSVKSRFTISRDDSKNTLYLQMNSLRAEDTAVYYCVRHGNFGNSYVSFFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 455 aa, Artificial Sequence
  SEQ ID NO: 68 - SP34 humanized heavy chain with VH5 domain
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSYFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 217 aa, Artificial Sequence
  SEQ ID NO: 69 - SP34 humanized light chain with VL1 domain
EAVVTQSPATLSVSPGERATLSCRSSTGAVTTSNYANWVQEKPGQAFRGLIGGANKRAPGVPARFSGSLSGDEATLTISSLQSEDFAVYFCQLWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - protein, 217 aa, Artificial Sequence
  SEQ ID NO: 70 - SP34 humanized light chain with VL2 domain
EAVVTQSPATLSVSPGERATLSCRSSTGAVTTSNYANWVQEKPGQAFRGLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 216 aa, Artificial Sequence
  SEQ ID NO: 71 - SP34 humanized light chain with VL3 domain
EAVVTQSATLSVSPGERATLSCRSSTGAVTTSNYANWVQEKPGQAFRGLIGGANKRAPGVPARFSGSLSGDEATLTISSLQSEDFAVYFCQLWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 72 - protein, 216 aa, Artificial Sequence
  SEQ ID NO: 72 - SP34 humanized light chain with VL4 domain
EAVVTQSATLSVSPGERATLSCRSSTGAVTTSNYANWVQEKPGQAFRGLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 217 aa, Artificial Sequence
  SEQ ID NO: 73 - SP34 humanized light chain with VL5 domain
EIVVTQSPATLSVSPGERATLSCRSSTGAVTTSNYANWVQEKPGQAFRGLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 74 - protein, 217 aa, Artificial Sequence
  SEQ ID NO: 74 - SP34 humanized light chain with VL6 domain
EAVVTQSPATLSVSPGERATLSCRSSTGAVTTSNYANWVQEKPGQAPRGLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 75 - protein, 217 aa, Artificial Sequence
  SEQ ID NO: 75 - SP34 humanized light chain with VL7 domain
EIVVTQSPATLSVSPGERATLSCRSSTGAVTTSNYANWVQEKPGQAPRGLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 76 - protein, 217 aa, Artificial Sequence
  SEQ ID NO: 76 - SP34 humanized light chain with VL8 domain
EAVVTQSPATLSVSPGERATLSCRSSTGAVTTSNYANWVQEKPGQAFRGLIGGANKRAPGVPARFSGSGSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 77 - protein, 217 aa, Artificial Sequence
  SEQ ID NO: 77 - SP34 humanized light chain with VL9 domain
EIVVTQSPATLSVSPGERATLSCRSSTGAVTTSNYANWVQEKPGQAFRGLIGGANKRAPGVPARFSGSGSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 78 - protein, 217 aa, Artificial Sequence
  SEQ ID NO: 78 - SP34 humanized light chain with VL10 domain
EAVVTQSPATLSVSPGERATLSCRSSTGAVTTSNYANWVQEKPGQAFRGLIGGANKRAPGVPARFSGSLSGDEATLTISSLQSEDFAVYYCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 79 - protein, 217 aa, Artificial Sequence
  SEQ ID NO: 79 - SP34 humanized light chain with VL11 domain
EAVVTQSPATLSVSPGERATLSCRSSTGAVTTSNYANWVQEKPGQAFRGLIGGANKRAPGVPARFSGSGSGTEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 80 - protein, 217 aa, Artificial Sequence
  SEQ ID NO: 80 - SP34 humanized light chain with VL12 domain
EAVVTQSPATLSVSPGERATLSCRSSTGAVTTSNYANWVQEKPGQAFRGLIGGANKRAPGVPARFSGSLSGTEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - protein, 217 aa, Artificial Sequence
  SEQ ID NO: 81 - SP34 humanized light chain with VL13 domain
EAVVTQSPATLSVSPGERATLSCRASTGAVTTSNYANWVQEKPGQAFRGLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 82 - protein, 217 aa, Artificial Sequence
  SEQ ID NO: 82 - SP34 humanized light chain with VL14 domain
EAVVTQSPATLSVSPGERATLSCRSSTGAVTTSNYANWVQEKPGQAFRLLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 217 aa, Artificial Sequence
  SEQ ID NO: 83 - SP34 humanized light chain with VL15 domain
EAVVTQSPATLSVSPGERATLSCRSSTGAVTTSNYANWVQQKPGQAFRGLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 84 - protein, 217 aa, Artificial Sequence
  SEQ ID NO: 84 - SP34 humanized light chain with VL16 domain
EIVVTQSPATLSVSPGERATLSCRSSTGAVTTSNYANWVQEKPGQAFRGLIGGANKRAPGVPARFSGSLSGTEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 217 aa, Artificial Sequence
  SEQ ID NO: 85 - SP34 humanized light chain with VL17 domain
EIVVTQSPATLSVSPGERATLSCRASTGAVTTSNYANWVQEKPGQAFRGLIGGANKRAPGVPARFSGSLSGDEATLTISSLQSEDFAVYFCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 217 aa, Artificial Sequence
  SEQ ID NO: 86 - SP34 humanized light chain with VL18 domain
EIVVTQSPATLSVSPGERATLSCRSSTGAVTTSNYANWVQEKPGQAFRGLIGGANKRAPGVPARFSGSLSGDEATLTISSLQSEDFAVYFCALWYSNLWVFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 87 - protein, 217 aa, Artificial Sequence
  SEQ ID NO: 87 - SP34 humanized light chain with VL19 domain
EIVVTQSPATLSVSPGERATLSCRSSTGAVTTSNYANWVQEKPGQAFRGLIGGANKRAPGVPARFSGSLSGTEATLTISSLQSEDFAVYYCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 217 aa, Artificial Sequence
  SEQ ID NO: 88 - SP34 humanized light chain with VL20 domain
EIVVTQSPATLSVSPGERATLSCRSSTGAVTTSNYANWVQQKPGQAFRGLIGGANKRAPGVPARFSGSLSGTEATLTISSLQSEDFAVYYCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - protein, 217 aa, Artificial Sequence
  SEQ ID NO: 89 - SP34 humanized light chain with VL21 domain
EIVVTQSPATLSVSPGERATLSCRSSTGAVTTSNYANWVQEKPGQAFRGLIGGANKRAPGVPARFSGSLSGDEATLTISSLQSEDFAVYYCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 217 aa, Artificial Sequence
  SEQ ID NO: 90 - SP34 humanized light chain with VL22 domain
EIVVTQSPATLSVSPGERATLSCRSSTGAVTTSNYANWVQQKPGQAFRGLIGGANKRAPGVPARFSGSLSGDEATLTISSLQSEDFAVYYCALWYSNLWVFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - protein, 482 aa, Artificial Sequence
  SEQ ID NO: 91 - scFv fragment  humanized SP34 VH2-VL21 - human IgG1 Fc fusion
EVQLVESGGGLVQPGGSLRLSCAASGFTFNTYAMNWVRQAPGKGLEWVARIRSKYNNYATYYADSVKSRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAVTTSNYANWVQEKPGQAFRGLIGGANKRAPGVPARFSGSLSGDEATLTISSLQSEDFAVYYCALWYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 482 aa, Artificial Sequence
  SEQ ID NO: 92 - scFv fragment  humanized SP34 VH3-VL23 - human IgG1 Fc fusion
EVQLVESGGGLVQPGGSLRLSCAASGFTFNTYAMNWVRQAPGKGLEWVARIRSKYNNYATYYADSVKSRFTISRDDSKNTLYLQMNSLRAEDTAVYYCVRHGNFGNSYVSYFAYWGQGTTVTVSSGGGGSGGGGSGGGGSEIVVTQSPATLSVSPGERATLSCRSSTGAVTTSNYANWVQEKPGQAFRGLIGGANKRAPGVPARFSGSLSGDEATLTISSLQSEDFAVYYCALFYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 482 aa, Artificial Sequence
  SEQ ID NO: 93 - scFv fragment  humanized SP34 VH4-VL23 - human IgG1 Fc fusion
EVQLVESGGGLVQPGGSLRLSCAASGFTFNTYAMNWVRQAPGKGLEWVARIRSKYNNYATYYADSVKSRFTISRDDSKNTLYLQMNSLRAEDTAVYYCVRHGNFGNSYVSFFAYWGQGTTVTVSSGGGGSGGGGSGGGGSEIVVTQSPATLSVSPGERATLSCRSSTGAVTTSNYANWVQEKPGQAFRGLIGGANKRAPGVPARFSGSLSGDEATLTISSLQSEDFAVYYCALFYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 482 aa, Artificial Sequence
  SEQ ID NO: 94 - scFv fragment  humanized SP34 VH5-VL23 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSYFAYWGQGTTVTVSSGGGGSGGGGSGGGGSEIVVTQSPATLSVSPGERATLSCRSSTGAVTTSNYANWVQEKPGQAFRGLIGGANKRAPGVPARFSGSLSGDEATLTISSLQSEDFAVYYCALFYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 482 aa, Artificial Sequence
  SEQ ID NO: 95 - scFv fragment  humanized SP34 VH1-VL27 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAVTTSAAANWVQEKPGQAFRGLIGGANKRAPGVPARFSGSLSGDEATLTISSLQSEDFAVYYCALWYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 482 aa, Artificial Sequence
  SEQ ID NO: 96 - scFv fragment  humanized SP34 VH1-VL28 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAVTTSNYANWVQEKPGQAFRGLIGGAAARAPGVPARFSGSLSGDEATLTISSLQSEDFAVYYCALWYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 482 aa, Artificial Sequence
  SEQ ID NO: 97 - scFv fragment  humanized SP34 VH1-VL29 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAVTTSNYANWVQEKPGQAFRGLIGGANKAAAGVPARFSGSLSGDEATLTISSLQSEDFAVYYCALWYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 482 aa, Artificial Sequence
  SEQ ID NO: 98 - scFv fragment  humanized SP34 VH1-VL30 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAVTTSNYANWVQEKPGQAFRGLIGGANKRAPGVPARFSGSLSGDEATLTISSLQSEDFAVYYCALWAANLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 482 aa, Artificial Sequence
  SEQ ID NO: 99 - scFv fragment  humanized SP34 VH1-VL31 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAVTTSNYANWVQEKPGQAFRGLIGGANKRAPGVPARFSGSLSGDEATLTISSLQSEDFAVYYCALWYSALWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 482 aa, Artificial Sequence
  SEQ ID NO: 100 - scFv fragment  humanized SP34 VH5-VL32 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSYFAYWGQGTTVTVSSGGGGSGGGGSGGGGSEIVVTQSPATLSVSPGERATLSCRSSTGAVTAANYANWVQEKPGQAFRGLIGGANKRAPGVPARFSGSLSGDEATLTISSLQSEDFAVYYCALFYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 125 aa, Artificial Sequence
  SEQ ID NO: 101 - SP34 humanized VH1 domain
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSS

SEQ ID NO: 102 - protein, 125 aa, Artificial Sequence
  SEQ ID NO: 102 - SP34 humanized VH2 domain
EVQLVESGGGLVQPGGSLRLSCAASGFTFNTYAMNWVRQAPGKGLEWVARIRSKYNNYATYYADSVKSRFTISRDDSKNTLYLQMNSLRAEDTAVYYCVRHGNFGNSYVSWFAYWGQGTTVTVSS

SEQ ID NO: 103 - protein, 125 aa, Artificial Sequence
  SEQ ID NO: 103 - SP34 humanized VH3 domain
EVQLVESGGGLVQPGGSLRLSCAASGFTFNTYAMNWVRQAPGKGLEWVARIRSKYNNYATYYADSVKSRFTISRDDSKNTLYLQMNSLRAEDTAVYYCVRHGNFGNSYVSYFAYWGQGTTVTVSS

SEQ ID NO: 104 - protein, 125 aa, Artificial Sequence
  SEQ ID NO: 104 - SP34 humanized VH5 domain
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSYFAYWGQGTTVTVSS

SEQ ID NO: 105 - protein, 110 aa, Artificial Sequence
  SEQ ID NO: 105 - SP34 humanized VL21 domain
EIVVTQSPATLSVSPGERATLSCRSSTGAVTTSNYANWVQEKPGQAFRGLIGGANKRAPGVPARFSGSLSGDEATLTISSLQSEDFAVYYCALWYSNLWVFGQGTKLEIK

SEQ ID NO: 106 - protein, 110 aa, Artificial Sequence
  SEQ ID NO: 106 - SP34 humanized VL32 domain
EIVVTQSPATLSVSPGERATLSCRSSTGAVTAANYANWVQEKPGQAFRGLIGGANKRAPGVPARFSGSLSGDEATLTISSLQSEDFAVYYCALFYSNLWVFGQGTKLEIK

SEQ ID NO: 107 - protein, 242 aa, Artificial Sequence
  SEQ ID NO: 107 - Humanized anti-HER2 antibody 4D5 - scFv fragment
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK

SEQ ID NO: 108 - protein, 120 aa, Artificial Sequence
  SEQ ID NO: 108 - Humanized anti-HER2 antibody 4D5 - FAB  fragment heavy chain (VH-VH1)with VH:G65S substitution
EVQLVESGGGLVQPGGSLRLSCAASGFNIKDTYIHWVRQAPGKGLEWVARIYPTNGYTRYADSVKSRFTISADTSKNTAYLQMNSLRAEDTAVYYCSRWGGDGFYAMDYWGQGTLVTVSS

SEQ ID NO: 109 - protein, 242 aa, Artificial Sequence
  SEQ ID NO: 109 - Humanized anti-HER2 antibody 4D5 - scFv fragment with VH:G65S substitution
EVQLVESGGGLVQPGGSLRLSCAASGFNIKDTYIHWVRQAPGKGLEWVARIYPTNGYTRYADSVKSRFTISADTSKNTAYLQMNSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK

SEQ ID NO: 110 - protein, 120 aa, Artificial Sequence
  SEQ ID NO: 110 - Humanized anti-HER2 antibody 4D5 - FAB  fragment heavy chain (VH-VH1)with VH:N82aS substitution
EVQLVESGGGLVQPGGSLRLSCAASGFNIKDTYIHWVRQAPGKGLEWVARIYPTNGYTRYADSVKGRFTISADTSKNTAYLQMSSLRAEDTAVYYCSRWGGDGFYAMDYWGQGTLVTVSS

SEQ ID NO: 111 - protein, 242 aa, Artificial Sequence
  SEQ ID NO: 111 - Humanized anti-HER2 antibody 4D5 - scFv fragment with VH:N82aS substitution
EVQLVESGGGLVQPGGSLRLSCAASGFNIKDTYIHWVRQAPGKGLEWVARIYPTNGYTRYADSVKGRFTISADTSKNTAYLQMSSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIK

SEQ ID NO: 112 - protein, 109 aa, Artificial Sequence
  SEQ ID NO: 112 - OKT10 mouse VH domain
QVELVESGGSLKLSCAASGFDFSRSWMNWVRQAPGKGLEWIGEINPDSSTINYTTSLKDKFIISRDNAKNTLYLQMTKVRSEDTALYYCARYGNWFPYWGQGTLVTVSS

SEQ ID NO: 113 - protein, 108 aa, Artificial Sequence
  SEQ ID NO: 113 - OKT10 mouse VL domain
DILMTQSQKIMPTSVGDRVSVTCKASQNVDTNVAWYQQKPGQSPKALIYSASYRYSGVPDRFTGSGSGTDFTLTITNVQSEDLAEYFCQQYDSYPLTFGAGTKLDLKR

SEQ ID NO: 114 - protein, 119 aa, Artificial Sequence
  SEQ ID NO: 114 - HB-7 mouse VH domain
KVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSS

SEQ ID NO: 115 - protein, 106 aa, Artificial Sequence
  SEQ ID NO: 115 - HB-7 mouse VL domain
DIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIK

SEQ ID NO: 116 - protein, 119 aa, Artificial Sequence
  SEQ ID NO: 116 - Humanized HB-7 best-fit VH domain
QVQLQESGPGLVKPSETLSLTCTVSGFSLISYGVHWVRQPPGKGLEWLGVIWRGGSTDYNAAFMSRLTISKDNSKNQVSLKLSSVTAADTAVYFCAKTLITTGYAMDYWGQGTLVTVSS

SEQ ID NO: 117 - protein, 106 aa, Artificial Sequence
  SEQ ID NO: 117 - Humanized HB-7 best-fit VL domain
DIQLTQSPSSLSASVGDRVTITCRASEDIYNRLAWYQQKPGKAPKLLISGATSLETGVPSRFSGSGSGKDYTLTISSLQPEDFATYYCQQYWSTPTFGQGTKLEIK

SEQ ID NO: 118 - protein, 449 aa, Artificial Sequence
  SEQ ID NO: 118 - Humanized HB-7 best-fit heavy chain
QVQLQESGPGLVKPSETLSLTCTVSGFSLISYGVHWVRQPPGKGLEWLGVIWRGGSTDYNAAFMSRLTISKDNSKNQVSLKLSSVTAADTAVYFCAKTLITTGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 213 aa, Artificial Sequence
  SEQ ID NO: 119 - Humanized HB-7 best-fit light chain
DIQLTQSPSSLSASVGDRVTITCRASEDIYNRLAWYQQKPGKAPKLLISGATSLETGVPSRFSGSGSGKDYTLTISSLQPEDFATYYCQQYWSTPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 120 - protein, 449 aa, Artificial Sequence
  SEQ ID NO: 120 - Chimeric HB-7 heavy chain IgG1
KVQLQESGPSLVQPSQRLSITCTVSGFSLISYGVHWVRQSPGKGLEWLGVIWRGGSTDYNAAFMSRLSITKDNSKSQVFFKMNSLQADDTAIYFCAKTLITTGYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 213 aa, Artificial Sequence
  SEQ ID NO: 121 - Chimeric HB-7 human kappa light chain
DIELTQSPSSFSVSLGDRVTITCKASEDIYNRLAWYQQKPGNAPRLLISGATSLETGVPSRFSGSGSGKDYTLSITSLQTEDVATYYCQQYWSTPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 121 aa, Artificial Sequence
  SEQ ID NO: 122 - 9G7 mouse VH domain
QVTLKESGPGILQPSQTLSLTCSFSGLSLSTSGKGVGWIRQPSGKGLEWLAHIWWDDDKRYNPALKSRLTISKDTSSNQVFLKIASVDTADTATYYCARIELGRSYVMDYWGQGTTVTVSS

SEQ ID NO: 123 - protein, 107 aa, Artificial Sequence
  SEQ ID NO: 123 - 9G7 mouse VL domain
DIVMTQSHKFMSTSVGDRVSISCKASQDVITSVAWFQQKPGQSPKLLIYSASYRYTGVPDRFTGSGSGTDFTFTISSVQAEDLAVYYCQQHYTIPLTFGAGTKLELK

SEQ ID NO: 124 - protein, 451 aa, Artificial Sequence
  SEQ ID NO: 124 - Humanized 9G7 best-fit heavy chain
QVTLKESGPTLVKPTQTLTLTCTFSGLSLSTSGKGVGWIRQPPGKALEWLAHIWWDDDKRYNPALKSRLTITKDTSKNQVVLTMTNMDPVDTATYYCARIELGRSYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 214 aa, Artificial Sequence
  SEQ ID NO: 125 - Humanized 9G7 best-fit first prototype light chain
DIQMTQSPSSLSASVGDRVTITCQASQDVITSVAWFQQKPGKAPKLLIYSASYRYTGVPSRFSGSGSGTDFTFTISSLQPEDIATYYCQQHYTIPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 451 aa, Artificial Sequence
  SEQ ID NO: 126 - Chimeric 9G7 heavy chain IgG1
QVTLKESGPGILQPSQTLSLTCSFSGLSLSTSGKGVGWIRQPSGKGLEWLAHIWWDDDKRYNPALKSRLTISKDTSSNQVFLKIASVDTADTATYYCARIELGRSYVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 214 aa, Artificial Sequence
  SEQ ID NO: 127 - Chimeric 9G7 human kappa light chain
DIVMTQSHKFMSTSVGDRVSISCKASQDVITSVAWFQQKPGQSPKLLIYSASYRYTGVPDRFTGSGSGTDFTFTISSVQAEDLAVYYCQQHYTIPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 128 - protein, 214 aa, Artificial Sequence
  SEQ ID NO: 128 - Humanized 9G7 best-fit light chain (prototype light chain with F36Y substitution)
DIQMTQSPSSLSASVGDRVTITCQASQDVITSVAWYQQKPGKAPKLLIYSASYRYTGVPSRFSGSGSGTDFTFTISSLQPEDIATYYCQQHYTIPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 129 - protein, 121 aa, Artificial Sequence
  SEQ ID NO: 129 - Humanized 9G7 best-fit VH domain
QVTLKESGPTLVKPTQTLTLTCTFSGLSLSTSGKGVGWIRQPPGKALEWLAHIWWDDDKRYNPALKSRLTITKDTSKNQVVLTMTNMDPVDTATYYCARIELGRSYVMDYWGQGTLVTVSS

SEQ ID NO: 130 - protein, 107 aa, Artificial Sequence
  SEQ ID NO: 130 - Humanized 9G7 best-fit VL domain
DIQMTQSPSSLSASVGDRVTITCQASQDVITSVAWFQQKPGKAPKLLIYSASYRYTGVPSRFSGSGSGTDFTFTISSLQPEDIATYYCQQHYTIPLTFGQGTKLEIK

SEQ ID NO: 131 - protein, 451 aa, Artificial Sequence
  SEQ ID NO: 131 - Humanized 9G7 best-framework heavy chain
EVQLVESGGGLVQPGGSLRLSCAFSGLSLSTSGKGVGWIRQAPGKGLEWLAHIWWDDDKRYNPALKSRLTISKDTSKNTVYLQMNSLRAEDTAVYYCARIELGRSYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 214 aa, Artificial Sequence
  SEQ ID NO: 132 - Humanized 9G7 best-framework light chain
DIQMTQSPSSLSASVGDRVTITCRASQDVITSVAWFQQKPGKAPKLLIYSASYRYTGVPSRFSGSGSGTDFTLTISSLQPEDFATYYCQQHYTIPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 121 aa, Artificial Sequence
  SEQ ID NO: 133 - Humanized 9G7 best-framework VH domain
EVQLVESGGGLVQPGGSLRLSCAFSGLSLSTSGKGVGWIRQAPGKGLEWLAHIWWDDDKRYNPALKSRLTISKDTSKNTVYLQMNSLRAEDTAVYYCARIELGRSYVMDYWGQGTLVTVSS

SEQ ID NO: 134 - protein, 107 aa, Artificial Sequence
  SEQ ID NO: 134 - Humanized 9G7 best-framework VL domain
DIQMTQSPSSLSASVGDRVTITCRASQDVITSVAWFQQKPGKAPKLLIYSASYRYTGVPSRFSGSGSGTDFTLTISSLQPEDFATYYCQQHYTIPLTFGQGTKVEIK

SEQ ID NO: 135 - protein, 118 aa, Artificial Sequence
  SEQ ID NO: 135 - Human clone 767 VH domain
QVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREGRTGYFDYWGQGTLVTVSS

SEQ ID NO: 136 - protein, 111 aa, Artificial Sequence
  SEQ ID NO: 136 - Human clone 767 VL domain
QSVLTQPPSASGTPGQRVTISCSGSTSNIGTNYVYWYQQLPGTAPKLLIYRNDQRPSGVPDRFSGSKSGTSASLAISGLRSEDEADYYCAAWDDSRSGVYAFGTGTKVTVL

SEQ ID NO: 137 - protein, 448 aa, Artificial Sequence
  SEQ ID NO: 137 - Human 767 heavy chain
QVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREGRTGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 218 aa, Artificial Sequence
  SEQ ID NO: 138 - Human 767 light chain
QSVLTQPPSASGTPGQRVTISCSGSTSNIGTNYVYWYQQLPGTAPKLLIYRNDQRPSGVPDRFSGSKSGTSASLAISGLRSEDEADYYCAAWDDSRSGVYAFGTGTKVTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - protein, 118 aa, Artificial Sequence
  SEQ ID NO: 139 - Mouse anti-human OX40 antibody VH domain from WO2013/008171
QVTLKESGPGILQPSQTLSLTCSFSGFSLSTSGMGVGWIRQPSGKGLEWLAHIWWDDDKYYNTALKSGLTISKDTSKNQVFLKIASVDTTDTATYYCARIDWDGFAYWGQGTLVTVSS

SEQ ID NO: 140 - protein, 106 aa, Artificial Sequence
  SEQ ID NO: 140 - Mouse anti-human OX40 antibody VL domain from WO2013/008171
QIVLTQSPAILSASPGEKVTMTCRASSSVSYMHWYQQKPGSSPKPWIYATSNLASGVPARFSGSGSGTSYSLTINRVEAEDAATYYCQQWSSNPWTFGGGTKLEIK

SEQ ID NO: 141 - protein, 118 aa, Artificial Sequence
  SEQ ID NO: 141 - Humanized anti-human OX40 antibody VH domain from WO2013/008171
QVTLKESGPALVKPTQTLTLTCSFSGFSLSTSGMGVGWIRQPPGKALEWIAHIWWDDDKYYNTALKTRLTISKDTSKNQVVLTMTNMDPVDTATYYCARIDWDGFAYWGQGTLVTVSS

SEQ ID NO: 142 - protein, 106 aa, Artificial Sequence
  SEQ ID NO: 142 - Humanized anti-human OX40 antibody VL domain from WO2013/008171
EIVLTQSPATLSLSPGERATLSCRASSSVSYMHWYQQKPGQAPRPWIYATSNRATGIPARFSGSGSGTDYTLTISSLEPEDFAVYYCQQWSSNPWTFGQGTKVEIK

SEQ ID NO: 143 - protein, 121 aa, Artificial Sequence [sequence omitted]

SEQ ID NO: 144 - protein, 108 aa, Artificial Sequence
  SEQ ID NO: 144 - rituximab mouse VL domain
QIVLSQSPAILSASPGEKVTMETTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 145 - protein, 119 aa, Artificial Sequence
  SEQ ID NO: 145 - cetuximab mouse VH domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 146 - protein, 107 aa, Artificial Sequence
  SEQ ID NO: 146 - cetuximab mouse VL domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 147 - protein, 107 aa, Artificial Sequence
  SEQ ID NO: 147 - BTA CH3 NO: 1 Original BTA  11
GQPREPQVYTLPPSRDELTKNQVKLVCLVTGFYPSDIAVEWESNGQPENNYYTTPPVLDSDGSFSLVSWLNVDKSRWQQGNVFSCSVMHEALHNHYTQKSLSLSPGK

SEQ ID NO: 148 - protein, 107 aa, Artificial Sequence
  SEQ ID NO: 148 - BTA CH3 NO: 2 BTA FTO 11
GQPREPAVYTLPPSRDELTKNQVKLVCLVTGFYPSDIAVEWESNGQPENNYYTTPPVLDSDGSFSLVSWLNVDKSRWQQGNVFSCSVMHEALHNHYTQKSLSLSPGK

SEQ ID NO: 149 - protein, 107 aa, Artificial Sequence
  SEQ ID NO: 149 - BTA CH3 NO: 3 BTA FTO 33 411D
GQPREPAVYTLPPSREEMTKNQVKLVCLVTGFYPSDIAVEWESSGQPENNYYTTPPMLDSDGSFSLVSWLDVDKSRWQQGNIFSCSVMHEALHNRFTQKSLSLSPGK

SEQ ID NO: 150 - protein, 107 aa, Artificial Sequence
  SEQ ID NO: 150 - BTB CH3 NO: 1 Original BTB
GQPREPEVATFPPSRDELTKNQVTLVCLVTGFYPSDIAVEWESNGQPENNYKTDPPLLESDGSFALSSRLRVDKSRWQQGNVFSCSVMHEALHNHYTQKSLSLSPGK

SEQ ID NO: 151 - protein, 107 aa, Artificial Sequence
  SEQ ID NO: 151 - BTB CH3 NO: 2 BTB 401R 11
GQPREPEVATFPPSRDELTKNQVTLVCLVTGFYPSDIAVEWESNGQPENNYKTDPPLLESRGSFALSSRLRVDKSRWQQGNVFSCSVMHEALHNHYTQKSLSLSPGK

SEQ ID NO: 152 - protein, 107 aa, Artificial Sequence
  SEQ ID NO: 152 - BTB CH3 No: 3 BTB 401Q 11
GQPREPEVATFPPSRDELTKNQVTLVCLVTGFYPSDIAVEWESNGQPENNYKTDPPLLESQGSFALSSRLRVDKSRWQQGNVFSCSVMHEALHNHYTQKSLSLSPGK

SEQ ID NO: 153 - protein, 107 aa, Artificial Sequence
  SEQ ID NO: 153 - BTA CH3 NO: 4 BTA 11_FTO_N411T
GQPREPAVYTLPPSRDELTKNQVKLVCLVTGFYPSDIAVEWESNGQPENNYYTTPPVLDSDGSFSLVSWLTVDKSRWQQGNVFSCSVMHEALHNHYTQKSLSLSPGK

SEQ ID NO: 154 - protein, 107 aa, Artificial Sequence
  SEQ ID NO: 154 - BTA CH3 NO: 5 BTA 33_FTO
GQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPGK

SEQ ID NO: 155 - protein, 107 aa, Artificial Sequence
  SEQ ID NO: 155 - BTA CH3 NO: 6 BTA 33_FTO_N411T
GQPREPAVYTLPPSREEMTKNQVKLVCLVTGFYPSDIAVEWESSGQPENNYYTTPPMLDSDGSFSLVSWLTVDKSRWQQGNIFSCSVMHEALHNRFTQKSLSLSPGK

SEQ ID NO: 156 - protein, 107 aa, Artificial Sequence
  SEQ ID NO: 156 - BTB CH3 No: 4 BTB 33_D401Q
GQPREPEVATFPPSREEMTKNQVTLVCLVTGFYPSDIAVEWESSGQPENNYNTDPPLLESQGSFALSSRLRVDKSRWQQGNIFSCSVMHEALHNRFTQKSLSLSPGK

SEQ ID NO: 157 - protein, 107 aa, Artificial Sequence
  SEQ ID NO: 157 - BTB CH3 No: 5 BTB 11_D401Q_R411T
GQPREPEVATFPPSRDELTKNQVTLVCLVTGFYPSDIAVEWESNGQPENNYKTDPPLLESQGSFALSSRLTVDKSRWQQGNVFSCSVMHEALHNHYTQKSLSLSPGK

SEQ ID NO: 158 - protein, 107 aa, Artificial Sequence
  SEQ ID NO: 158 - BTB CH3 No: 6 BTB 33_D401Q_R411T
GQPREPEVATFPPSREEMTKNQVTLVCLVTGFYPSDIAVEWESSGQPENNYNTDPPLLESQGSFALSSRLTVDKSRWQQGNIFSCSVMHEALHNRFTQKSLSLSPGK

SEQ ID NO: 159 - protein, 449 aa, Artificial Sequence
  SEQ ID NO: 159 - BEAT HER2/CD3-1 antibody FAB heavy chain (CD3 epsilon arm - humanized OKT3 with N82aS substitution)
EVQLVESGGGLVQPGGSLRLSCAASGYTFTRYTMHWVRQAPGKGLEWIGYINPSRGYTYYADSVKGRFTLSTDKSKNTAYLQMSSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPGK

SEQ ID NO: 160 - protein, 475 aa, Artificial Sequence
  SEQ ID NO: 160 - BEAT HER2/CD3-1 antibody scFv heavy chain (HER2 arm)
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRGGGGTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPEVATFPPSRDELTKNQVTLVCLVTGFYPSDIAVEWESNGQPENNYKTDPPLLESDGSFALSSRLRVDKSRWQQGNVFSCSVMHEALHNHYTQKSLSLSPGK

SEQ ID NO: 161 - protein, 450 aa, Artificial Sequence
  SEQ ID NO: 161 - BEAT HER2/CD3-2 antibody FAB heavy chain (HER2 arm)
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTNGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPAVYTLPPSRDELTKNQVKLVCLVTGFYPSDIAVEWESNGQPENNYYTTPPVLDSDGSFSLVSWLNVDKSRWQQGNVFSCSVMHEALHNHYTQKSLSLSPGK

SEQ ID NO: 162 - protein, 477 aa, Artificial Sequence
  SEQ ID NO: 162 - BEAT HER2/CD3-2 antibody scFv heavy chain (CD3 epsilon arm - humanized OKT3 with N82aS substitution)
EVQLVESGGGLVQPGGSLRLSCAASGYTFTRYTMHWVRQAPGKGLEWIGYINPSRGYTYYADSVKGRFTLSTDKSKNTAYLQMSSLRAEDTAVYYCARYYDDHYCLDYWGQGTLVTVSSGGGGSGGGGSGGGGSGGGASDIQLTQSPSSLSASVGDRVTITCRASSSVSYVAWYQQKPGKAPKRWIYDTSKLYSGVPSRFSGSGSGTDYTLTISSLQPEDFATYYCQQWSSNPPTFGQGTKVEIKGGGGTDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPEVATFPPSREEMTKNQVTLVCLVTGFYPSDIAVEWESSGQPENNYNTDPPLLESDGSFALSSRLRVDKSRWQQGNIFSCSVMHEALHNRFTQKSLSLSPGK

SEQ ID NO: 163 - protein, 449 aa, Artificial Sequence
  SEQ ID NO: 163 - BEAT HER2/CD3-3 antibody FAB heavy chain(CD3 epsilon arm - humanized OKT3 with G65S substitution)
EVQLVESGGGLVQPGGSLRLSCAASGYTFTRYTMHWVRQAPGKGLEWIGYINPSRGYTYYADSVKSRFTLSTDKSKNTAYLQMNSLRAEDTAVYYCARYYDDHYCLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPGK

SEQ ID NO: 164 - protein, 474 aa, Artificial Sequence
  SEQ ID NO: 164 - BEAT HER2/CD3-3 antibody scFv heavy chain (HER2 arm with additional disulfide bond)
EVQLVESGGGLVQPGGSLRLSCAASGFNIKDTYIHWVRQAPGKCLEWVARIYPTNGYTRYADSVKGRFTISADTSKNTAYLQMNSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGCGTKVEIKGGGGTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPEVATFPPSRDELTKNQVTLVCLVTGFYPSDIAVEWESNGQPENNYKTDPPLLESQGSFALSSRLRVDKSRWQQGNVFSCSVMHEALHNHYTQKSLSLSPGK

SEQ ID NO: 165 - protein, 455 aa, Artificial Sequence
  SEQ ID NO: 165 - BEAT HER2/CD3(SP34) antibody FAB heavy chain(CD3 epsilon arm - humanized SP34 VH from WO2008/119565)
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPAVYTLPPSRDELTKNQVKLVCLVTGFYPSDIAVEWESNGQPENNYYTTPPVLDSDGSFSLVSWLNVDKSRWQQGNVFSCSVMHEALHNHYTQKSLSLSPGK

SEQ ID NO: 166 - protein, 217 aa, Artificial Sequence
  SEQ ID NO: 166 - BEAT HER2/CD3(SP34) antibody FAB light chain(CD3 epsilon arm - humanized SP34 VL from WO2008/119565)
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 167 - protein, 474 aa, Artificial Sequence
  SEQ ID NO: 167 - BEAT HER2/CD3(SP34) antibody scFv heavy chain (HER2 arm with N82aS substitution)
EVQLVESGGGLVQPGGSLRLSCAASGFNIKDTYIHWVRQAPGKGLEWVARIYPTNGYTRYADSVKGRFTISADTSKNTAYLQMSSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGGGTDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPEVATFPPSREEMTKNQVTLVCLVTGFYPSDIAVEWESSGQPENNYNTDPPLLESQGSFALSSRLRVDKSRWQQGNIFSCSVMHEALHNRFTQKSLSLSPGK

SEQ ID NO: 168 - protein, 455 aa, Artificial Sequence
  SEQ ID NO: 168 - BEAT HER2/CD3(SP34-Kappa1) antibody FAB heavy chain(CD3 epsilon arm - humanized SP34 VH1)
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPAVYTLPPSRDELTKNQVKLVCLVTGFYPSDIAVEWESNGQPENNYYTTPPVLDSDGSFSLVSWLNVDKSRWQQGNVFSCSVMHEALHNHYTQKSLSLSPGK

SEQ ID NO: 169 - protein, 449 aa, Artificial Sequence
  SEQ ID NO: 169 - BEAT CD38-HB7bestfit/CD3 antibody FAB heavy chain (CD38 arm - humanized HB-7 best-fit)
QVQLQESGPGLVKPSETLSLTCTVSGFSLISYGVHWVRQPPGKGLEWLGVIWRGGSTDYNAAFMSRLTISKDNSKNQVSLKLSSVTAADTAVYFCAKTLITTGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPAVYTLPPSRDELTKNQVKLVCLVTGFYPSDIAVEWESNGQPENNYYTTPPVLDSDGSFSLVSWLNVDKSRWQQGNVFSCSVMHEALHNHYTQKSLSLSPGK

SEQ ID NO: 170 - protein, 449 aa, Artificial Sequence
  SEQ ID NO: 170 - BEAT CD38-767/CD3 antibody FAB heavy chain (CD38 arm - human clone 767)
QVQLQESGPGLVKPSETLSLTCTVSGFSLISYGVHWVRQPPGKGLEWLGVIWRGGSTDYNAAFMSRLTISKDNSKNQVSLKLSSVTAADTAVYFCAKTLITTGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPGK

SEQ ID NO: 171 - protein, 482 aa, Artificial Sequence
  SEQ ID NO: 171 - BEAT CD38-767/CD3 antibody scFv heavy chain(CD3 epsilon arm - humanized OKT3 with G65S substitution)
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGGTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPEVATFPPSRDELTKNQVTLVCLVTGFYPSDIAVEWESNGQPENNYKTDPPLLESQGSFALSSRLRVDKSRWQQGNVFSCSVMHEALHNHYTQKSLSLSPGK

SEQ ID NO: 172 - protein, 448 aa, Artificial Sequence
  SEQ ID NO: 172 - BEAT OX40/CD3 antibody FAB heavy chain (OX40 arm with humanized anti-human OX40 VH domain from WO2013/008171)
QVTLKESGPALVKPTQTLTLTCSFSGFSLSTSGMGVGWIRQPPGKALEWIAHIWWDDDKYYNTALKTRLTISKDTSKNQVVLTMTNMDPVDTATYYCARIDWDGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPAVYTLPPSRDELTKNQVKLVCLVTGFYPSDIAVEWESNGQPENNYYTTPPVLDSDGSFSLVSWLNVDKSRWQQGNVFSCSVMHEALHNHYTQKSLSLSPGK

SEQ ID NO: 173 - protein, 213 aa, Artificial Sequence
  SEQ ID NO: 173 - BEAT OX40/CD3 antibody FAB light chain (OX40 arm with humanized anti-human OX40 VL domain from WO2013/008171)
EIVLTQSPATLSLSPGERATLSCRASSSVSYMHWYQQKPGQAPRPWIYATSNRATGIPARFSGSGSGTDYTLTISSLEPEDFAVYYCQQWSSNPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 174 - protein, 449 aa, Artificial Sequence
  SEQ ID NO: 174 - BEAT EGFR/CD3 antibody FAB heavy chain (EGFR arm with mouse Erbitux VH domain)
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPAVYTLPPSRDELTKNQVKLVCLVTGFYPSDIAVEWESNGQPENNYYTTPPVLDSDGSFSLVSWLNVDKSRWQQGNVFSCSVMHEALHNHYTQKSLSLSPGK

SEQ ID NO: 175 - protein, 214 aa, Artificial Sequence
  SEQ ID NO: 175 - BEAT EGFR/CD3 antibody FAB light chain (EGFR arm with mouse Erbitux VL domain)
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 176 - protein, 449 aa, Artificial Sequence; identical to SEQ ID NO: 170
  SEQ ID NO: 176 - BEAT CD38-HB7bestfit/CD3(SP34)antibody FAB heavy chain (CD38 arm - humanized HB-7 best-fit)

SEQ ID NO: 177 - protein, 482 aa, Artificial Sequence; identical to SEQ ID NO: 171
  SEQ ID NO: 177 - BEST CD38-HB7bestfit/CD3(SP34) antibody scFv heavy chain (CD3 arm - humanized SP34 VH/VL domains from WO2008/119565)

SEQ ID NO: 178 - protein, 451 aa, Artificial Sequence
  SEQ ID NO: 178 - BEAT CD38-9G7bestfit/CD3(SP34)antibody FAB heavy chain (CD38 arm - humanized 9G7 best-fit VH)
QVTLKESGPTLVKPTQTLTLTCTFSGLSLSTSGKGVGWIRQPPGKALEWLAHIWWDDDKRYNPALKSRLTITKDTSKNQVVLTMTNMDPVDTATYYCARIELGRSYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPGK

SEQ ID NO: 179 - protein, 482 aa, Artificial Sequence
  SEQ ID NO: 179 - BEAT CD38-9G7bestfit/CD3(SP34-Kappa2) antibody scFv heavy chain (CD3 arm - humanized SP34 VH5/VL32)v
  misc_feature (213)..(213): Xaa can be any naturally occurring amino acid
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAVTTSNYANWVQEKPGQAFRGLIGGANKRAPGVPARFSGSLSGDXATLTISSLQSEDFAVYYCALWYSNLWVFGQGTKLEIKGGGGTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPEVATFPPSRDELTKNQVTLVCLVTGFYPSDIAVEWESNGQPENNYKTDPPLLESQGSFALSSRLRVDKSRWQQGNVFSCSVMHEALHNHYTQKSLSLSPGK

SEQ ID NO: 180 - protein, 451 aa, Artificial Sequence
  SEQ ID NO: 180 - BEAT CD20/CD3 antibody FAB heavy chain
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPGK

SEQ ID NO: 181 - protein, 215 aa, Artificial Sequence
  SEQ ID NO: 181 - BEAT CD20/CD3 antibody FAB light chain
QIVLSQSPAILSASPGEKVTMETTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 182 - protein, 121 aa, Artificial Sequence [sequence omitted]

SEQ ID NO: 183 - protein, 121 aa, Artificial Sequence [sequence omitted]

SEQ ID NO: 184 - protein, 94 aa, Artificial Sequence
  SEQ ID NO: 184 - Human CD3 gamma extracellular region
QSIKGNHLVKVYDYQEDGSVLLTCDAEAKNITWFKDGKMIGFLTEDKKKWNLGSNAKDPRGMYQCKGSQNKSKPLQVYYRMCQNCIELNAATIS

SEQ ID NO: 185 - protein, 104 aa, Artificial Sequence
  SEQ ID NO: 185 - Human CD3 epsilon extracellular region
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 186 - protein, 26 aa, Artificial Sequence
  SEQ ID NO: 186 - 26-residue peptide linker
GSADDAKKDAAKKDDAKKDDAKKDGS

SEQ ID NO: 187 - protein, 435 aa, Artificial Sequence
  SEQ ID NO: 187 - Human CD3 gamma-epsilon-Fc fusion protein
QSIKGNHLVKVYDYQEDGSVLLTCDAEAKNITWFKDGKMIGFLTEDKKKWNLGSNAKDPRGMYQCKGSQNKSKPLQVYYRMGSADDAKKDAAKKDDAKKDDAKKDGSQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 188 - protein, 26 aa, Artificial Sequence
  SEQ ID NO: 188 - Human CD3 epsilon 1-26 amino acid sequence
QDGNEEMGGITQTPYKVSISGTTVIL

SEQ ID NO: 189 - protein, 26 aa, Artificial Sequence
  SEQ ID NO: 189 - Cynomolgus monkey CD3 epsilon 1-26 amino acid sequence
QDGNEEMGSITQTPYQVSISGTTVIL

SEQ ID NO: 190 - protein, 258 aa, Artificial Sequence
  SEQ ID NO: 190 - Human CD3 epsilon 1-26 Fc fusion
QDGNEEMGGITQTPYKVSISGTTVILGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 258 aa, Artificial Sequence
  SEQ ID NO: 191 - Cynomolgus monkey CD3 epsilon 1-26 Fc fusion
QDGNEEMGSITQTPYQVSISGTTVILGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - protein, 264 aa, Artificial Sequence
  SEQ ID NO: 192 - Human CD38 extracellular region fused to a polyhistine tag - amino acid sequence
VPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEIHHHHHH

SEQ ID NO: 193 - protein, 264 aa, Artificial Sequence
  SEQ ID NO: 193 - Cynomolgus monkey CD38 extracellular region fused to a polyhistine tag - amino acid sequence
VPRWRQQWSGSGTTSRFPETVLARCVKYTEVHPEMRHVDCQSVWDAFKGAFISKYPCNITEEDYQPLVKLGTQTVPCNKTLLWSRIKDLAHQFTQVQRDMFTLEDMLLGYLADDLTWCGEFNTFEINYQSCPDWRKDCSNNPVSVFWKTVSRRFAETACGVVHVMLNGSRSKIFDKNSTFGSVEVHNLQPEKVQALEAWVIHGGREDSRDLCQDPTIKELESIISKRNIRFFCKNIYRPDKFLQCVKNPEDSSCLSGIHHHHHH

SEQ ID NO: 194 - protein, 8 aa, Artificial Sequence
  SEQ ID NO: 194 - Mouse anti- human CD3 epsilon OKT3 CDR H1
GYTFTRYT

SEQ ID NO: 195 - protein, 8 aa, Artificial Sequence
  SEQ ID NO: 195 - Mouse anti- human CD3 epsilon OKT3 CDR H2
INPSRGYT

SEQ ID NO: 196 - protein, 12 aa, Artificial Sequence
  SEQ ID NO: 196 - Mouse anti- human CD3 epsilon OKT3 CDR H3
ARYYDDHYCLDY

SEQ ID NO: 197 - protein, 5 aa, Artificial Sequence
  SEQ ID NO: 197 - Mouse anti- human CD3 epsilon OKT3 CDR L1
SSVSY

SEQ ID NO: 198 - protein, 3 aa, Artificial Sequence
  SEQ ID NO: 198 - Mouse anti- human CD3 epsilon OKT3 CDR L2
DTS

SEQ ID NO: 199 - protein, 9 aa, Artificial Sequence
  SEQ ID NO: 199 - Mouse anti- human CD3 epsilon OKT3 CDR L3
QQWSSNPPT

SEQ ID NO: 200 - protein, 8 aa, Artificial Sequence
  SEQ ID NO: 200 - Mouse anti- human CD3 epsilon SP34 CDR H1
GFTFNTYA

SEQ ID NO: 201 - protein, 10 aa, Artificial Sequence
  SEQ ID NO: 201 - Mouse anti- human CD3 epsilon SP34 CDR H2
IRSKYNNYAT

SEQ ID NO: 202 - protein, 16 aa, Artificial Sequence
  SEQ ID NO: 202 - Mouse anti- human CD3 epsilon SP34 CDR H3
VRHGNFGNSYVSWFAY

SEQ ID NO: 203 - protein, 9 aa, Artificial Sequence
  SEQ ID NO: 203 - Mouse anti- human CD3 epsilon SP34 CDR L1
TGAVTTSNY

SEQ ID NO: 204 - protein, 3 aa, Artificial Sequence
  SEQ ID NO: 204 - Mouse anti- human CD3 epsilon SP34 CDR L2
GTN

SEQ ID NO: 205 - protein, 9 aa, Artificial Sequence
  SEQ ID NO: 205 - Mouse anti- human CD3 epsilon SP34 CDR L3
ALWYSNLWV

SEQ ID NO: 206 - protein, 8 aa, Artificial Sequence
  SEQ ID NO: 206 - Herceptin (trastuzumab)CDR H1
GFNIKDTY

SEQ ID NO: 207 - protein, 8 aa, Artificial Sequence
  SEQ ID NO: 207 - Herceptin (trastuzumab) CDR H2
IYPTNGYT

SEQ ID NO: 208 - protein, 13 aa, Artificial Sequence
  SEQ ID NO: 208 - Herceptin (trastuzumab) CDR H3
SRWGGDGFYAMDY

SEQ ID NO: 209 - protein, 6 aa, Artificial Sequence
  SEQ ID NO: 209 - Herceptin (trastuzumab) CDR L1
QDVNTA

SEQ ID NO: 210 - protein, 3 aa, Artificial Sequence
  SEQ ID NO: 210 - Herceptin (trastuzumab) CDR L2
SAS

SEQ ID NO: 211 - protein, 9 aa, Artificial Sequence
  SEQ ID NO: 211 - Herceptin (trastuzumab) CDR L3
QQHYTTPPT

SEQ ID NO: 212 - protein, 8 aa, Artificial Sequence
  SEQ ID NO: 212 - Mouse anti- human CD38 HB-7 CDR H1
GFSLISYG

SEQ ID NO: 213 - protein, 7 aa, Artificial Sequence
  SEQ ID NO: 213 - Mouse anti- human CD38 HB-7 CDR H2
IWRGGST

SEQ ID NO: 214 - protein, 13 aa, Artificial Sequence
  SEQ ID NO: 214 - Mouse anti- human CD38 HB-7 CDR H3
AKTLITTGYAMDY

SEQ ID NO: 215 - protein, 6 aa, Artificial Sequence
  SEQ ID NO: 215 - Mouse anti- human CD38 HB-7 CDR L1
EDIYNR

SEQ ID NO: 216 - protein, 3 aa, Artificial Sequence
  SEQ ID NO: 216 - Mouse anti- human CD38 HB-7 CDR L2
GAT

SEQ ID NO: 217 - protein, 8 aa, Artificial Sequence
  SEQ ID NO: 217 - Mouse anti- human CD38 HB-7 CDR L3
QQYWSTPT

SEQ ID NO: 218 - protein, 8 aa, Artificial Sequence
  SEQ ID NO: 218 - Mouse anti- human CD38 OKT10 CDR H1
GFDFSRSW

SEQ ID NO: 219 - protein, 9 aa, Artificial Sequence
  SEQ ID NO: 219 - Mouse anti- human CD38 OKT10 CDR H2
INPDSSTIV

SEQ ID NO: 220 - protein, 9 aa, Artificial Sequence
  SEQ ID NO: 220 - Mouse anti- human CD38 OKT10 CDR H3
ARYGNWFPY

SEQ ID NO: 221 - protein, 6 aa, Artificial Sequence
  SEQ ID NO: 221 - Mouse anti- human CD38 OKT10 CDR L1
QNVDTN

SEQ ID NO: 222 - protein, 3 aa, Artificial Sequence
  SEQ ID NO: 222 - Mouse anti- human CD38 OKT10 CDR L2
SAS

SEQ ID NO: 223 - protein, 15 aa, Artificial Sequence
  SEQ ID NO: 223 - Mouse anti- human CD38 OKT10 CDR L3
QQYDSYPLTFGAGTK

SEQ ID NO: 224 - protein, 10 aa, Artificial Sequence
  SEQ ID NO: 224 - Mouse anti- human CD38 9G7 CDR H1
GLSLSTSGKG

SEQ ID NO: 225 - protein, 7 aa, Artificial Sequence
  SEQ ID NO: 225 - Mouse anti- human CD38 9G7 CDR H2
IWWDDDK

SEQ ID NO: 226 - protein, 13 aa, Artificial Sequence
  SEQ ID NO: 226 - Mouse anti- human CD38 9G7 CDR H3
ARIELGRSYVMDY

SEQ ID NO: 227 - protein, 6 aa, Artificial Sequence
  SEQ ID NO: 227 - Mouse anti- human CD38 9G7 CDR L1
QDVITS

SEQ ID NO: 228 - protein, 3 aa, Artificial Sequence
  SEQ ID NO: 228 - Mouse anti- human CD38 9G7 CDR L2
SAS

SEQ ID NO: 229 - protein, 9 aa, Artificial Sequence
  SEQ ID NO: 229 - Mouse anti- human CD38 9G7 CDR L3
QQHYTIPLT

SEQ ID NO: 230 - protein, 8 aa, Artificial Sequence
  SEQ ID NO: 230 - Human anti- human CD38 767 CDR H1
GFTFSSYW

SEQ ID NO: 231 - protein, 8 aa, Artificial Sequence
  SEQ ID NO: 231 - Human anti- human CD38767 CDR H2
IKQDGSEK

SEQ ID NO: 232 - protein, 11 aa, Artificial Sequence
  SEQ ID NO: 232 - Human anti- human CD38767 CDR H3
AREGRTGYFDY

SEQ ID NO: 233 - protein, 8 aa, Artificial Sequence
  SEQ ID NO: 233 - Human anti- human CD38767 CDR L1
TSNIGTNY

SEQ ID NO: 234 - protein, 3 aa, Artificial Sequence
  SEQ ID NO: 234 - Human anti- human CD38767 CDR L2
RND

SEQ ID NO: 235 - protein, 12 aa, Artificial Sequence
  SEQ ID NO: 235 - Human anti- human CD38767 CDR L3
AAWDDSRSGVYA

SEQ ID NO: 236 - protein, 10 aa, Artificial Sequence
  SEQ ID NO: 236 - Mouse anti-human OX40 CDR H1 from WO2013/008171
GFSLSTSGMG

SEQ ID NO: 237 - protein, 7 aa, Artificial Sequence
  SEQ ID NO: 237 - Mouse anti-human OX40 CDR H2 from WO2013/008171
IWWDDDK

SEQ ID NO: 238 - protein, 10 aa, Artificial Sequence
  SEQ ID NO: 238 - Mouse anti-human OX40 CDR H3 from WO2013/008171
ARIDWDGFAY

SEQ ID NO: 239 - protein, 5 aa, Artificial Sequence
  SEQ ID NO: 239 - Mouse anti-human OX40 CDR L1 from WO2013/008171
SSVSY

SEQ ID NO: 240 - protein, 3 aa, Artificial Sequence
  SEQ ID NO: 240 - Mouse anti-human OX40 CDR L2 from WO2013/008171
ATS

SEQ ID NO: 241 - protein, 9 aa, Artificial Sequence
  SEQ ID NO: 241 - Mouse anti-human OX40 CDR L3 from WO2013/008171
QQWSSNPWT

SEQ ID NO: 242 - protein, 8 aa, Artificial Sequence
  SEQ ID NO: 242 - Rituxan (rituximab) CDR H1
GYTFTSYN

SEQ ID NO: 243 - protein, 8 aa, Artificial Sequence
  SEQ ID NO: 243 - Rituxan (rituximab) CDR H2
IYPGNGDT

SEQ ID NO: 244 - protein, 14 aa, Artificial Sequence
  SEQ ID NO: 244 - Rituxan (rituximab) CDR H3
ARSTYYGGDWYFNV

SEQ ID NO: 245 - protein, 7 aa, Artificial Sequence
  SEQ ID NO: 245 - Rituxan (rituximab) CDR L1
ASSSVSY

SEQ ID NO: 246 - protein, 3 aa, Artificial Sequence
  SEQ ID NO: 246 - Rituxan (rituximab) CDR L2
ATS

SEQ ID NO: 247 - protein, 9 aa, Artificial Sequence
  SEQ ID NO: 247 - Rituxan (rituximab) CDR L3
QQWTSNPPT

SEQ ID NO: 248 - protein, 8 aa, Artificial Sequence
  SEQ ID NO: 248 - Erbitux (cetuximab) CDR H1
GFSLTNYG

SEQ ID NO: 249 - protein, 7 aa, Artificial Sequence
  SEQ ID NO: 249 - Erbitux (cetuximab) CDR H2
IWSGGNT

SEQ ID NO: 250 - protein, 13 aa, Artificial Sequence
  SEQ ID NO: 250 - Erbitux (cetuximab) CDR H3
ARALTYYDYEFAY

SEQ ID NO: 251 - protein, 6 aa, Artificial Sequence
  SEQ ID NO: 251 - Erbitux (cetuximab) CDR L1
QSIGTN

SEQ ID NO: 252 - protein, 3 aa, Artificial Sequence
  SEQ ID NO: 252 - Erbitux (cetuximab) CDR L2
YAS

SEQ ID NO: 253 - protein, 9 aa, Artificial Sequence
  SEQ ID NO: 253 - Erbitux (cetuximab) CDR L3
QQNNNWPTT

SEQ ID NO: 254 - protein, 10 aa, Artificial Sequence
  SEQ ID NO: 254 - Vectibix (panitumumab) CDR H1
GGSVSSGDYY

SEQ ID NO: 255 - protein, 7 aa, Artificial Sequence
  SEQ ID NO: 255 - Vectibix (panitumumab) CDR H2
IYYSGNT

SEQ ID NO: 256 - protein, 11 aa, Artificial Sequence
  SEQ ID NO: 256 - Vectibix (panitumumab) CDR H3
VRDRVTGAFDI

SEQ ID NO: 257 - protein, 6 aa, Artificial Sequence
  SEQ ID NO: 257 - Vectibix (panitumumab) CDR L1
QDISNY

SEQ ID NO: 258 - protein, 3 aa, Artificial Sequence
  SEQ ID NO: 258 - Vectibix (panitumumab) CDR L2
DAS

SEQ ID NO: 259 - protein, 9 aa, Artificial Sequence
  SEQ ID NO: 259 - Vectibix (panitumumab) CDR L3
QHFDHLPLA

SEQ ID NO: 260 - protein, 8 aa, Artificial Sequence
  SEQ ID NO: 260 - Mouse anti-human CD19 CDR H1 from WO2010/095031
GVSLPDYG

SEQ ID NO: 261 - protein, 7 aa, Artificial Sequence
  SEQ ID NO: 261 - Mouse anti-human CD19 CDR H2 from WO2010/095031
IWGSETT

SEQ ID NO: 262 - protein, 14 aa, Artificial Sequence
  SEQ ID NO: 262 - Mouse anti-human CD19 CDR H3 from WO2010/095031
AKHYYYGGSYAMDY

SEQ ID NO: 263 - protein, 6 aa, Artificial Sequence
  SEQ ID NO: 263 - Mouse anti-human CD19 CDR L1 from WO2010/095031
QDISKY

SEQ ID NO: 264 - protein, 3 aa, Artificial Sequence
  SEQ ID NO: 264 - Mouse anti-human CD19 CDR L2 from WO2010/095031
HTS

SEQ ID NO: 265 - protein, 9 aa, Artificial Sequence
  SEQ ID NO: 265 - Mouse anti-human CD19 CDR L3 from WO2010/095031
QQGATLPYT

SEQ ID NO: 266 - protein, 8 aa, Artificial Sequence
  SEQ ID NO: 266 - Bsw17 CDR H1
GFTFSSYA

SEQ ID NO: 267 - protein, 7 aa, Artificial Sequence
  SEQ ID NO: 267 - Bsw17 CDR H2
ISSGNII

SEQ ID NO: 268 - protein, 12 aa, Artificial Sequence
  SEQ ID NO: 268 - Bsw17 CDR H3
TRGRSTYGGFDH

SEQ ID NO: 269 - protein, 5 aa, Artificial Sequence
  SEQ ID NO: 269 - Bsw17 CDR L1
SSVTF

SEQ ID NO: 270 - protein, 3 aa, Artificial Sequence
  SEQ ID NO: 270 - Bsw17 CDR L2
DTS

SEQ ID NO: 271 - protein, 9 aa, Artificial Sequence
  SEQ ID NO: 271 - Bsw17 CDR L3
QHWSGNPLT

SEQ ID NO: 272 - protein, 9 aa, Artificial Sequence
  SEQ ID NO: 272 - Omalizumab CDR H1
GYSITSGYS

SEQ ID NO: 273 - protein, 7 aa, Artificial Sequence
  SEQ ID NO: 273 - Omalizumab CDR H2
ITYDGST

SEQ ID NO: 274 - protein, 14 aa, Artificial Sequence
  SEQ ID NO: 274 - Omalizumab CDR H3
ARGSHYFGHWHFAV

SEQ ID NO: 275 - protein, 10 aa, Artificial Sequence
  SEQ ID NO: 275 - Omalizumab CDR L1
QSVDYDGDSY

SEQ ID NO: 276 - protein, 3 aa, Artificial Sequence
  SEQ ID NO: 276 - Omalizumab CDR L2
AAS

SEQ ID NO: 277 - protein, 9 aa, Artificial Sequence
  SEQ ID NO: 277 - Omalizumab CDR L3
QQSHEDPYT

SEQ ID NO: 278 - protein, 118 aa, Artificial Sequence
  SEQ ID NO: 278 - Humanized anti-OX40/mingraft VH domain
EVQLVESGGGLVQPGGSLRLSCAASGFSLSTSGMGMSWVRQAPGKGLEWVSAIWWDDDKYYADSVKGRFTISRDNSKNTLYLQMNSLRAEDTAVYYCARIDWDGFAYWGQGTLVTVSS

SEQ ID NO: 279 - protein, 118 aa, Artificial Sequence
  SEQ ID NO: 279 - Humanized anti-OX40/maxgraft VH domain
EVQLVESGGGLVQPGGSLRLSCAFSGFSLSTSGMGVGWIRQAPGKGLEWLAHIWWDDDKYYNTALKSGLTISKDTSKNTVYLQMNSLRAEDTAVYYCARIDWDGFAYWGQGTLVTVSS

SEQ ID NO: 280 - protein, 106 aa, Artificial Sequence
  SEQ ID NO: 280 - Humanized anti-OX40/mingraft VL domain
DIQMTQSPSSLSASVGDRVTITCRASSSVSYLNWYQQKPGKAPKLLIYATSSLQSGVPSRFSGSGSGTDFTLTISSLQPEDFATYYCQQWSSNPWTFGQGTKVEIK

SEQ ID NO: 281 - protein, 106 aa, Artificial Sequence
  SEQ ID NO: 281 - Humanized anti-OX40/maxgraft VL domain
DIQLTQSPSSLSASVGDRVTITCRASSSVSYMHWYQQKPGKAPKPWIYATSNLASGVPSRFSGSGSGTDYTLTISSLQPEDFATYYCQQWSSNPWTFGQGTKVEIK

SEQ ID NO: 282 - protein, 121 aa, Artificial Sequence
  SEQ ID NO: 282 - Humanized Rituximab/mingraft VH domain
EVQLVESGGGLVQPGGSLRLSCAASGYTFTSYNMSWVRQAPGKGLEWVSAIYPGNGDTYYADSVKGRFTISRDNSKNTLYLQMNSLRAEDTAVYYCARSTYYGGDWYFNVWGQGTLVTVSS

SEQ ID NO: 283 - protein, 121 aa, Artificial Sequence
  SEQ ID NO: 283 - Humanized Rituximab/maxgraft VH domain
EVQLVESGGGLVQPGGSLRLSCAASGYTFTSYNMSWVRQAPGKGLEWIGAIYPGNGDTYYADSVKGRATLSADKSKNTAYLQMNSLRAEDTAVYYCARSTYYGGDWYFNVWGQGTLVTVSS

SEQ ID NO: 284 - protein, 108 aa, Artificial Sequence
  SEQ ID NO: 284 - Humanized Rituximab/mingraft VL domain
DIQMTQSPSSLSASVGDRVTITCRASASSSVSYLNWYQQKPGKAPKLLIYATSSLQSGVPSRFSGSGSGTDFTLTISSLQPEDFATYYCQQWTSNPPTFGQGTKVEIK

SEQ ID NO: 285 - protein, 108 aa, Artificial Sequence
  SEQ ID NO: 285 - Humanized Rituximab/maxgraft VL domain
DIQLTQSPSSLSASVGDRVTITCRLSASSSVSYLNWFQQKPGKAPKPWIYATSSLQSGVPSRFSGSGSGTDYTLTISSLQPEDFATYYCQQWTSNPPTFGQGTKVEIK

SEQ ID NO: 286 - protein, 119 aa, Artificial Sequence
  SEQ ID NO: 286 - Humanized Erbitux/mingraft VH domain
EVQLVESGGGLVQPGGSLRLSCAASGFSLTNYGMSWVRQAPGKGLEWVSAIWSGGNTYYADSVKGRFTISRDNSKNTLYLQMNSLRAEDTAVYYCARALTYYDYEFAYWGQGTLVTVSS

SEQ ID NO: 287 - protein, 119 aa, Artificial Sequence
  SEQ ID NO: 287 - Humanized Erbitux/maxgraft VH domain
EVQLVESGGGLVQPGGSLRLSCAASGFSLTNYGVHWVRQAPGKGLEWLGAIWSGGNTDYNTPFTGRLTISKDNSKNTLYLQMNSLRAEDTAVYYCARALTYYDYEFAYWGQGTLVTVSS

SEQ ID NO: 288 - protein, 107 aa, Artificial Sequence
  SEQ ID NO: 288 - Humanized Erbitux/mingraft VL domain
DIQMTQSPSSLSASVGDRVTITCRASQSIGTNLNWYQQKPGKAPKLLIYYASSLQSGVPSRFSGSGSGTDFTLTISSLQPEDFATYYCQQNNNWPTTFGQGTKVEIK

SEQ ID NO: 289 - protein, 107 aa, Artificial Sequence
  SEQ ID NO: 289 - Humanized Erbitux/maxgraft VL domain
DIQLTQSPSSLSASVGDRVTITCRASQSIGTNIHWYQQKPGKAPKLLIKYASESISGVPSRFSGSGSGTDFTLTISSLQPEDFATYYCQQNNNWPTTFGQGTKVEIK

SEQ ID NO: 290 - protein, 119 aa, Artificial Sequence [sequence omitted]

SEQ ID NO: 291 - protein, 107 aa, Artificial Sequence [sequence omitted]

SEQ ID NO: 292 - protein, 119 aa, Artificial Sequence
  SEQ ID NO: 292 - Humanized Vectibix/mingraft VH domain
EVQLVESGGGLVQPGGSLRLSCAASGGSVSSGDYYMSWVRQAPGKGLEWVSAIYYSGNTYYADSVKGRFTISRDNSKNTLYLQMNSLRAEDTAVYYCVRDRVTGAFDIWGQGTLVTVSS

SEQ ID NO: 293 - protein, 119 aa, Artificial Sequence
  SEQ ID NO: 293 - Humanized Vectibix/maxgraft VH domain
EVQLVESGGGLVQPGGSLRLSCAVSGGSVSSGDYYMSWVRQAPGKGLEWIGAIYYSGNTYYADSVKGRLTISIDTSKNTFYLQMNSLRAEDTAVYYCVRDRVTGAFDIWGQGTLVTVSS

SEQ ID NO: 294 - protein, 107 aa, Artificial Sequence
  SEQ ID NO: 294 - Humanized Vectibix/mingraft VL domain
DIQMTQSPSSLSASVGDRVTITCRASQDISNYLNWYQQKPGKAPKLLIYDASSLQSGVPSRFSGSGSGTDFTLTISSLQPEDFATYYCQHFDHLPLAFGQGTKVEIK

SEQ ID NO: 295 - protein, 107 aa, Artificial Sequence [sequence omitted]

SEQ ID NO: 296 - protein, 120 aa, Artificial Sequence
  SEQ ID NO: 296 - anti-human CD19 VH domain from WO2010/095031
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSS

SEQ ID NO: 297 - protein, 107 aa, Artificial Sequence
  SEQ ID NO: 297 - anti-human CD19 VL domain from WO2010/095031
DIQMTQSPSSLSASVGDRVTITCRASQDISKYLNWYQQKPGKAIKLLIYHTSRLHSGVPSRFSGSGSGTDFTLTISSLQPEDFATYYCQQGATLPYTFGPGTKVDIK

SEQ ID NO: 298 - protein, 121 aa, Artificial Sequence
  SEQ ID NO: 298 - Omalizumab VH domain
EVQLVESGGGLVQPGGSLRLSCAVSGYSITSGYSWNWIRQAPGKGLEWVASITYDGSTNYADSVKGRFTISRDDSKNTFYLQMNSLRAEDTAVYYCARGSHYFGHWHFAVWGQGTLVTVSS

SEQ ID NO: 299 - protein, 111 aa, Artificial Sequence [sequence omitted]

SEQ ID NO: 300 - protein, 121 aa, Artificial Sequence; identical to SEQ ID NO: 298
  SEQ ID NO: 300 - Stabilized Omalizumab/maxgraft VH domain

SEQ ID NO: 301 - protein, 121 aa, Artificial Sequence
  SEQ ID NO: 301 - Stabilized Omalizumab/mingraft VH domain
EVQLVESGGGLVQPGGSLRLSCAASGYSITSGYSMSWVRQAPGKGLEWVSAITYDGSTYYADSVKGRFTISRDNSKNTLYLQMNSLRAEDTAVYYCARGSHYFGHWHFAVWGQGTLVTVSS

SEQ ID NO: 302 - protein, 111 aa, Artificial Sequence [sequence omitted]

SEQ ID NO: 303 - protein, 111 aa, Artificial Sequence
  SEQ ID NO: 303 - Stabilized Omalizumab/mingraft VL domain
DIQMTQSPSSLSASVGDRVTITCRASQSVDYDGDSYLNWYQQKPGKAPKLLIYAASSLQSGVPSRFSGSGSGTDFTLTISSLQPEDFATYYCQQSHEDPYTFGQGTKVEIK

SEQ ID NO: 304 - protein, 118 aa, Artificial Sequence
  SEQ ID NO: 304 - Bsw17 mouse VH domain
EVQLLESGGGFVKPGGSLKLSCVVSGFTFSSYAMSWVRQTPEKRLEWVASISSGNIIYYPDNVKGRFTISRDNVRNILYLQMSSLRSEDTAMYYCTRGRSTYGGFDHWGQGTTLTVSS

SEQ ID NO: 305 - protein, 106 aa, Artificial Sequence
  SEQ ID NO: 305 - Bsw17 mouse VL domain
ELVMTQSPAIMSASPGEKVTMTCSASSSVTFIHWYRQKSGTSPKGWIYDTSKLASGVPARFSGSGSGTSYSLTISTMEAEDAATYYCQHWSGNPLTFGTGTKLELK

SEQ ID NO: 306 - protein, 118 aa, Artificial Sequence
  SEQ ID NO: 306 - Humanized Bsw17/mingraft VH domain
EVQLVESGGGLVQPGGSLRLSCAASGFTFSSYAMSWVRQAPGKGLEWVSAISSGNIIYYADSVKGRFTISRDNSKNTLYLQMNSLRAEDTAVYYCTRGRSTYGGFDHWGQGTLVTVSS

SEQ ID NO: 307 - protein, 118 aa, Artificial Sequence
  SEQ ID NO: 307 - Humanized Bsw17/maxgraft VH domain
EVQLVESGGGLVKPGGSLRLSCAVSGFTFSSYAMSWVRQAPGKGLEWVASISSGNIIYYPDNVKGRFTISRDNAKNSLYLQMNSLRAEDTAVYYCTRGRSTYGGFDHWGQGTTVTVSS

SEQ ID NO: 308 - protein, 106 aa, Artificial Sequence
  SEQ ID NO: 308 - Humanized Bsw17/mingraft VL domain
DIQMTQSPSSLSASVGDRVTITCRASSSVTFLNWYQQKPGKAPKLLIYDTSSLQSGVPSRFSGSGSGTDFTLTISSLQPEDFATYYCQHWSGNPLTFGQGTKVEIK

SEQ ID NO: 309 - protein, 106 aa, Artificial Sequence
  SEQ ID NO: 309 - Humanized Bsw17/maxgraft VL domain
DLQMTQSPSSLSASVGDRVTITCSASSSVTFLNWYQQKPGKAPWLLIYDTSSLQSGVPSRFSGSGSGTDYTLTISSMQPEDFATYYCQHWSGNPLTFGQGTKVEIK

SEQ ID NO: 310 - protein, 449 aa, Artificial Sequence
  SEQ ID NO: 310 - BEAT HER2/CD3(SP34-Kappa2) antibody FAB heavy chain (anti-HER2 FAB arm with G65S substitution BT33 LALA)
EVQLVESGGGLVQPGGSLRLSCAASGFNIKDTYIHWVRQAPGKGLEWVARIYPTNGYTRYADSVKSRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 311 - protein, 481 aa, Artificial Sequence
  SEQ ID NO: 311 - BEAT antibody scFv heavy chain SP34-Kappa2(anti-CD3 epsilon arm - humanized SP34 VH5/VL32 BT11 LALA)
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSYFAYWGQGTTVTVSSGGGGSGGGGSGGGGSEIVVTQSPATLSVSPGERATLSCRSSTGAVTAANYANWVQEKPGQAFRGLIGGANKRAPGVPARFSGSLSGDEATLTISSLQSEDFAVYYCALFYSNLWVFGQGTKLEIKGGGGTDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPEVATFPPSRDELTKNQVTLVCLVTGFYPSDIAVEWESNGQPENNYKTDPPLLESQGSFALSSRLRVDKSRWQQGNVFSCSVMHEALHNHYTQKSLSLSPG

SEQ ID NO: 312 - protein, 454 aa, Artificial Sequence
  SEQ ID NO: 312 - BEAT CD38-9G7bestframwork/CD3(SP34-Kappa2) antibody FAB heavy chain (anti-CD38 FAB arm with G65S substitution BT33 LALA)
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 313 - protein, 454 aa, Artificial Sequence
  SEQ ID NO: 313 - BEAT CD38-767/CD3(SP34-Kappa2) antibody FAB heavy chain (anti-CD38 FAB arm with G65S substitution BT33 LALA)
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 314 - protein, 447 aa, Artificial Sequence
  SEQ ID NO: 314 - BEAT OX40maxgraft/CD3(SP34-Kappa2) antibody FAB heavy chain (anti-OX40 maxgraft FAB arm with G65S substitution BT33 LALA)
EVQLVESGGGLVQPGGSLRLSCAFSGFSLSTSGMGVGWIRQAPGKGLEWLAHIWWDDDKYYNTALKSGLTISKDTSKNTVYLQMNSLRAEDTAVYYCARIDWDGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 315 - protein, 213 aa, Artificial Sequence
  SEQ ID NO: 315 - BEAT OX40maxgraft/CD3(SP34-Kappa2) antibody FAB light chain (anti-OX40 maxgraft FAB arm LC)
DIQLTQSPSSLSASVGDRVTITCRASSSVSYMHWYQQKPGKAPKPWIYATSNLASGVPSRFSGSGSGTDYTLTISSLQPEDFATYYCQQWSSNPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 316 - protein, 447 aa, Artificial Sequence
  SEQ ID NO: 316 - BEAT OX40mingraft/CD3(SP34-Kappa2) antibody FAB heavy chain (anti-OX40 mingraft FAB arm with G65S substitution BT33 LALA)
EVQLVESGGGLVQPGGSLRLSCAASGFSLSTSGMGMSWVRQAPGKGLEWVSAIWWDDDKYYADSVKSRFTISRDNSKNTLYLQMNSLRAEDTAVYYCARIDWDGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 317 - protein, 213 aa, Artificial Sequence
  SEQ ID NO: 317 - BEAT OX40mingraft/CD3(SP34-Kappa2) antibody FAB light chain (anti-OX40 mingraft FAB arm LC)
DIQMTQSPSSLSASVGDRVTITCRASSSVSYLNWYQQKPGKAPKLLIYATSSLQSGVPSRFSGSGSGTDFTLTISSLQPEDFATYYCQQWSSNPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 318 - protein, 450 aa, Artificial Sequence
  SEQ ID NO: 318 - BEAT CD20maxgraft/CD3(SP34-Kappa2) antibody FAB heavy chain (anti-CD20 maxgraft FAB arm with G65S substitution BT33 LALA)
EVQLVESGGGLVQPGGSLRLSCAASGYTFTSYNMSWVRQAPGKGLEWIGAIYPGNGDTYYADSVKSRATLSADKSKNTAYLQMNSLRAEDTAVYYCARSTYYGGDWYFNVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 319 - protein, 215 aa, Artificial Sequence
  SEQ ID NO: 319 - BEAT CD20maxgraft/CD3(SP34-Kappa2) antibody FAB light chain (anti-CD20 maxgraft FAB arm LC)
DIQLTQSPSSLSASVGDRVTITCRLSASSSVSYLNWFQQKPGKAPKPWIYATSSLQSGVPSRFSGSGSGTDYTLTISSLQPEDFATYYCQQWTSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 320 - protein, 450 aa, Artificial Sequence
  SEQ ID NO: 320 - BEAT CD20mingraft/CD3(SP34-Kappa2) antibody FAB heavy chain (anti-CD20 mingraft FAB arm with G65S substitution BT33 LALA)
EVQLVESGGGLVQPGGSLRLSCAASGYTFTSYNMSWVRQAPGKGLEWVSAIYPGNGDTYYADSVKSRFTISRDNSKNTLYLQMNSLRAEDTAVYYCARSTYYGGDWYFNVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 321 - protein, 215 aa, Artificial Sequence
  SEQ ID NO: 321 - BEAT CD20mingraft/CD3(SP34-Kappa2) antibody FAB light chain (anti-CD20 mingraft FAB arm LC)
DIQMTQSPSSLSASVGDRVTITCRASASSSVSYLNWYQQKPGKAPKLLIYATSSLQSGVPSRFSGSGSGTDFTLTISSLQPEDFATYYCQQWTSNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - protein, 448 aa, Artificial Sequence
  SEQ ID NO: 322 - BEAT EGFRcetux-maxgraft/CD3(SP34-Kappa2) antibody FAB heavy chain (anti-EGFR cetuximab maxgraft FAB arm with G65S substitution BT33 LALA)
EVQLVESGGGLVQPGGSLRLSCAASGFSLTNYGVHWVRQAPGKGLEWLGAIWSGGNTDYNTPFTSRLTISKDNSKNTLYLQMNSLRAEDTAVYYCARALTYYDYEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 323 - protein, 214 aa, Artificial Sequence
  SEQ ID NO: 323 - BEAT EGFRcetux-maxgraft/CD3(SP34-Kappa2) antibody FAB light chain (anti-EGFR cetuximab maxgraft FAB arm)
DIQLTQSPSSLSASVGDRVTITCRASQSIGTNIHWYQQKPGKAPKLLIKYASESISGVPSRFSGSGSGTDFTLTISSLQPEDFATYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 324 - protein, 448 aa, Artificial Sequence
  SEQ ID NO: 324 - BEAT EGFRcetux-mingraft/CD3(SP34-Kappa2) antibody FAB heavy chain (anti-EGFR cetuximab mingraft FAB arm with G65S substitution BT33 LALA)
EVQLVESGGGLVQPGGSLRLSCAASGFSLTNYGMSWVRQAPGKGLEWVSAIWSGGNTYYADSVKSRFTISRDNSKNTLYLQMNSLRAEDTAVYYCARALTYYDYEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 325 - protein, 214 aa, Artificial Sequence
  SEQ ID NO: 325 - BEAT EGFRcetux-mingraft/CD3(SP34-Kappa2) antibody FAB light chain (anti-EGFR cetuximab mingraft FAB arm)
DIQMTQSPSSLSASVGDRVTITCRASQSIGTNLNWYQQKPGKAPKLLIYYASSLQSGVPSRFSGSGSGTDFTLTISSLQPEDFATYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 448 aa, Artificial Sequence
  SEQ ID NO: 326 - BEAT EGFRpani-maxgraft/CD3(SP34-Kappa2) antibody FAB heavy chain (anti-EGFR panitumumab maxgraft FAB arm with G65S substitution BT33 LALA)
EVQLVESGGGLVQPGGSLRLSCAVSGGSVSSGDYYMSWVRQAPGKGLEWIGAIYYSGNTYYADSVKSRLTISIDTSKNTFYLQMNSLRAEDTAVYYCVRDRVTGAFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 327 - protein, 214 aa, Artificial Sequence
  SEQ ID NO: 327 - BEAT EGFRpani-maxgraft/CD3(SP34-Kappa2) antibody FAB light chain (anti-EGFR panitumumab maxgraft FAB arm)
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 448 aa, Artificial Sequence
  SEQ ID NO: 328 - BEAT EGFRpani-mingraft/CD3(SP34-Kappa2) antibody FAB heavy chain (anti-EGFR panitumumab mingraft FAB arm with G65S substitution BT33 LALA)
EVQLVESGGGLVQPGGSLRLSCAASGGSVSSGDYYMSWVRQAPGKGLEWVSAIYYSGNTYYADSVKSRFTISRDNSKNTLYLQMNSLRAEDTAVYYCVRDRVTGAFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 329 - protein, 214 aa, Artificial Sequence
  SEQ ID NO: 329 - BEAT EGFRpani-mingraft/CD3(SP34-Kappa2) antibody FAB light chain (anti-EGFR panitumumab mingraft FAB arm)
DIQMTQSPSSLSASVGDRVTITCRASQDISNYLNWYQQKPGKAPKLLIYDASSLQSGVPSRFSGSGSGTDFTLTISSLQPEDFATYYCQHFDHLPLAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 449 aa, Artificial Sequence
  SEQ ID NO: 330 - BEAT CD19/CD3(SP34-Kappa2) antibody FAB heavy chain (anti-CD19 FAB arm with G65S substitution BT33 LALA)
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 331 - protein, 214 aa, Artificial Sequence
  SEQ ID NO: 331 - BEAT CD19/CD3(SP34-Kappa2) antibody FAB light chain (anti-CD19 FAB arm)
DIQMTQSPSSLSASVGDRVTITCRASQDISKYLNWYQQKPGKAIKLLIYHTSRLHSGVPSRFSGSGSGTDFTLTISSLQPEDFATYYCQQGATLPYTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 450 aa, Artificial Sequence
  SEQ ID NO: 332 - BEAT IgEomali-maxgraft/CD3(SP34-Kappa2) antibody FAB heavy chain (anti-IgE omalizumab maxgraft FAB arm with G65S substitution BT33 LALA)
EVQLVESGGGLVQPGGSLRLSCAVSGYSITSGYSWNWIRQAPGKGLEWVASITYDGSTNYADSVKSRFTISRDDSKNTFYLQMNSLRAEDTAVYYCARGSHYFGHWHFAVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 333 - protein, 218 aa, Artificial Sequence
  SEQ ID NO: 333 - BEAT IgEomali-maxgraft/CD3(SP34-Kappa2) antibody FAB light chain (anti-IgE omalizumab maxgraft FAB arm)
DIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 334 - protein, 450 aa, Artificial Sequence
  SEQ ID NO: 334 - BEAT IgEomali-mingraft/CD3(SP34-Kappa2) antibody FAB heavy chain (anti-IgE omalizumab mingraft FAB arm with G65S substitution BT33 LALA)
EVQLVESGGGLVQPGGSLRLSCAASGYSITSGYSMSWVRQAPGKGLEWVSAITYDGSTYYADSVKSRFTISRDNSKNTLYLQMNSLRAEDTAVYYCARGSHYFGHWHFAVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 335 - protein, 218 aa, Artificial Sequence
  SEQ ID NO: 335 - BEAT IgEomali-mingraft/CD3(SP34-Kappa2) antibody FAB light chain (anti-IgE omalizumab mingraft FAB arm)
DIQMTQSPSSLSASVGDRVTITCRASQSVDYDGDSYLNWYQQKPGKAPKLLIYAASSLQSGVPSRFSGSGSGTDFTLTISSLQPEDFATYYCQQSHEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336 - protein, 447 aa, Artificial Sequence
  SEQ ID NO: 336 - BEAT IgEbsw17-maxgraft/CD3(SP34-Kappa2) antibody FAB heavy chain (anti-IgE omalizumab maxgraft FAB arm with G65S substitution BT33 LALA)
EVQLVESGGGLVKPGGSLRLSCAVSGFTFSSYAMSWVRQAPGKGLEWVASISSGNIIYYPDNVKSRFTISRDNAKNSLYLQMNSLRAEDTAVYYCTRGRSTYGGFDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 337 - protein, 213 aa, Artificial Sequence
  SEQ ID NO: 337 - BEAT IgEbsw17-maxgraft/CD3(SP34-Kappa2) antibody FAB light chain (anti-IgE omalizumab maxgraft FAB arm)
DLQMTQSPSSLSASVGDRVTITCSASSSVTFLNWYQQKPGKAPWLLIYDTSSLQSGVPSRFSGSGSGTDYTLTISSMQPEDFATYYCQHWSGNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 338 - protein, 447 aa, Artificial Sequence
  SEQ ID NO: 338 - BEAT IgEbsw17-mingraft/CD3(SP34-Kappa2) antibody FAB heavy chain (anti-IgE omalizumab mingraft FAB arm with G65S substitution BT33 LALA)
EVQLVESGGGLVQPGGSLRLSCAASGFTFSSYAMSWVRQAPGKGLEWVSAISSGNIIYYADSVKSRFTISRDNSKNTLYLQMNSLRAEDTAVYYCTRGRSTYGGFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 339 - protein, 213 aa, Artificial Sequence
  SEQ ID NO: 339 - BEAT IgEbsw17-mingraft/CD3(SP34-Kappa2) antibody FAB light chain (anti-IgE omalizumab mingraft FAB arm)
DIQMTQSPSSLSASVGDRVTITCRASSSVTFLNWYQQKPGKAPKLLIYDTSSLQSGVPSRFSGSGSGTDFTLTISSLQPEDFATYYCQHWSGNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 340 - protein, 447 aa, Artificial Sequence
  SEQ ID NO: 340 - BEAT OX40/CD3(SP34-Kappa2) antibody FAB heavy chain (anti-OX40 1D4 FAB arm BT33 LALA)
QVTLKESGPALVKPTQTLTLTCSFSGFSLSTSGMGVGWIRQPPGKALEWIAHIWWDDDKYYNTALKTRLTISKDTSKNQVVLTMTNMDPVDTATYYCARIDWDGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 341 - protein, 450 aa, Artificial Sequence
  SEQ ID NO: 341 - BEAT CD20/CD3(SP34-Kappa2) antibody FAB heavy chain (anti-CD20 rituximab FAB arm BT33 LALA)
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 342 - protein, 448 aa, Artificial Sequence
  SEQ ID NO: 342 - BEAT EGFRcetux/CD3(SP34-Kappa2) antibody FAB heavy chain (anti-EGFR cetuximab FAB arm BT33 LALA)
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 343 - protein, 448 aa, Artificial Sequence
  SEQ ID NO: 343 - BEAT EGFRpani/CD3(SP34-Kappa2) antibody FAB heavy chain (anti-EGFR panitumumab FAB arm BT33 LALA)
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 344 - protein, 214 aa, Artificial Sequence; identical to SEQ ID NO: 327
  SEQ ID NO: 344 - BEAT EGFRpani/CD3(SP34-Kappa2) antibody FAB light chain (anti-EGFR panitumumab FAB arm)

SEQ ID NO: 345 - protein, 450 aa, Artificial Sequence
  SEQ ID NO: 345 - BEAT IgEomali/CD3(SP34-Kappa2) antibody FAB heavy chain (anti-IgE omalizumab FAB arm BT33 LALA)
EVQLVESGGGLVQPGGSLRLSCAVSGYSITSGYSWNWIRQAPGKGLEWVASITYDGSTNYADSVKGRFTISRDDSKNTFYLQMNSLRAEDTAVYYCARGSHYFGHWHFAVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 346 - protein, 218 aa, Artificial Sequence; identical to SEQ ID NO: 333
  SEQ ID NO: 346 - BEAT IgEomali/CD3(SP34-Kappa2) antibody FAB light chain (anti-IgE omalizumab FAB arm)

SEQ ID NO: 347 - protein, 447 aa, Artificial Sequence
  SEQ ID NO: 347 - BEAT IgEbsw17/CD3(SP34-Kappa2) antibody FAB heavy chain (anti-IgE Bsw17 FAB arm BT33 LALA)
EVQLLESGGGFVKPGGSLKLSCVVSGFTFSSYAMSWVRQTPEKRLEWVASISSGNIIYYPDNVKGRFTISRDNVRNILYLQMSSLRSEDTAMYYCTRGRSTYGGFDHWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPAVYTLPPSREEMTKNQVKLVCLVTGFYPSDIAVEWESSGQPENNYYTTPPMLDSDGSFSLVSWLNVDKSRWQQGNIFSCSVMHEALHNRFTQKSLSLSPG

SEQ ID NO: 348 - protein, 213 aa, Artificial Sequence
  SEQ ID NO: 348 - BEAT IgEbsw17/CD3(SP34-Kappa2) antibody FAB light chain (anti-IgE Bsw17 FAB arm)
ELVMTQSPAIMSASPGEKVTMTCSASSSVTFIHWYRQKSGTSPKGWIYDTSKLASGVPARFSGSGSGTSYSLTISTMEAEDAATYYCQHWSGNPLTFGTGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 349 - protein, 482 aa, Artificial Sequence
  SEQ ID NO: 349 - scFv fragment  humanized SP34 VH1-VL24 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSAAAVTTSNYANWVQEKPGQAFRGLIGGANKRAPGVPARFSGSLSGDEATLTISSLQSEDFAVYYCALWYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 350 - protein, 482 aa, Artificial Sequence
  SEQ ID NO: 350 - scFv fragment  humanized SP34 VH1-VL25 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAAATSNYANWVQEKPGQAFRGLIGGANKRAPGVPARFSGSLSGDEATLTISSLQSEDFAVYYCALWYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 482 aa, Artificial Sequence
  SEQ ID NO: 351 - scFv fragment  humanized SP34 VH1-VL26 - human IgG1 Fc fusion
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSWFAYWGQGTTVTVSSGGGGSGGGGSGGGGSEIVVTQSPATLSVSPGERATLSCRSSTGAVTAANYANWVQEKPGQAFRGLIGGANKRAPGVPARFSGSLSGDEATLTISSLQSEDFAVYYCALWYSNLWVFGQGTKLEIKGGGGTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 352 - protein, 8 aa, Artificial Sequence
  SEQ ID NO: 352 - Humanized anti- human CD3 epsilon SP34 VH5 CDR H1
GFTFNTYA

SEQ ID NO: 353 - protein, 10 aa, Artificial Sequence
  SEQ ID NO: 353 - Humanized anti- human CD3 epsilon SP34 VH5 CDR H2
IRSKYNNYAT

SEQ ID NO: 354 - protein, 16 aa, Artificial Sequence
  SEQ ID NO: 354 - Humanized anti- human CD3 epsilon SP34 VH5 CDR H3
VRHGNFGNSYVSYFAY

SEQ ID NO: 355 - protein, 9 aa, Artificial Sequence
  SEQ ID NO: 355 - Humanized anti- human CD3 epsilon SP34 VL32 CDR L1
TGAVTAANY

SEQ ID NO: 356 - protein, 3 aa, Artificial Sequence
  SEQ ID NO: 356 - Humanized anti- human CD3 epsilon SP34 VL32 CDR L2
GAN

SEQ ID NO: 357 - protein, 9 aa, Artificial Sequence
  SEQ ID NO: 357 - Humanized anti- human CD3 epsilon SP34 VL32 CDR L3
ALFYSNLWV

SEQ ID NO: 358 - protein, 119 aa, Artificial Sequence
  SEQ ID NO: 358 - OKT3 humanized VH9 domain
EVQLVESGGGLVQPGGSLRLSCAASGYTFTRYTMHWVRQAPGKGLEWIGYINPSRGYTYYADSVKSRFTLSTDKSKNTAYLQMNSLRAEDTAVYYCARYYDDHYCLDYWGQGTLVTVSS

SEQ ID NO: 359 - protein, 455 aa, Artificial Sequence
  SEQ ID NO: 359 - SP34 humanized IgG1 heavy chain with VH5
EVQLVESGGGLVQPGGSLRLSCAASGFTFNTYAMNWVRQAPGKGLEWVARIRSKYNNYATYYADSVKGRFTISRDDSKNTLYLQMNSLRAEDTAVYYCVRHGNFGNSYVSYFAYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 218 aa, Artificial Sequence
  SEQ ID NO: 360 - SP34 humanized Light chain with VL32
EIVVTQSPATLSVSPGERATLSCRSSTGAVTAANYANWVQEKPGQAFRGLIGGANKRAPGVPARFSGSLSGDEATLTISSLQSEDFAVYYCALFYSNLWVFGQGTKLEIKKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 361 - protein, 98 aa, Artificial Sequence
  Human IGHV1-3
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCAR

SEQ ID NO: 362 - protein, 100 aa, Artificial Sequence
  Human IGHV2-26
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARI

SEQ ID NO: 363 - protein, 98 aa, Artificial Sequence
  Human IGHV3-23
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 364 - protein, 98 aa, Artificial Sequence
  Human IGHV4-28
QVQLQESGPGLVKPSDTLSLTCAVSGYSISSSNWWGWIRQPPGKGLEWIGYIYYSGSTYYNPSLKSRVTMSVDTSKNQFSLKLSSVTAVDTAVYYCAR

SEQ ID NO: 365 - protein, 98 aa, Artificial Sequence
  Human IGHV5-51
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCAR

SEQ ID NO: 366 - protein, 101 aa, Artificial Sequence
  Human IGHV6-1
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAR

SEQ ID NO: 367 - protein, 98 aa, Artificial Sequence
  Human IGHV7-4-1
QVQLVQSGSELKKPGASVKVSCKASGYTFTSYAMNWVRQAPGQGLEWMGWINTNTGNPTYAQGFTGRFVFSLDTSVSTAYLQICSLKAEDTAVYYCAR

What is claimed is:

1. A hetero-dimeric immunoglobulin or fragment thereof comprising a first polypeptide and a second polypeptide, wherein the hetero-dimeric immunoglobulin or fragment thereof binds to:
   i) the CD3 protein complex and HER2, wherein the first polypeptide has an amino acid sequence of SEQ ID NO: 159 and is assembled with a light chain amino acid sequence of SEQ ID NO: 47 and binds CD3 epsilon, and wherein the second polypeptide has an amino acid sequence of SEQ ID NO: 160 and binds HER2;
   ii) the CD3 protein complex and HER2, wherein the first polypeptide has an amino acid sequence of SEQ ID NO: 161 and is assembled with a cognate light chain amino acid sequence of SEQ ID NO: 3 and binds HER2, and wherein the second polypeptide has an amino acid sequence of SEQ ID NO: 162 and binds CD3 epsilon;
   iii) the CD3 protein complex and HER2, wherein the first polypeptide has an amino acid sequence of SEQ ID NO: 163 and is assembled with a light chain amino acid sequence of SEQ ID NO: 47 and binds CD3 epsilon, and wherein the second polypeptide has an amino acid sequence of SEQ ID NO: 164 and binds HER2;
   iv) the CD3 protein complex and HER2, wherein the first polypeptide has an amino acid sequence of SEQ ID NO: 165 and is assembled with a light chain amino acid sequence of SEQ ID NO: 166 and binds CD3 epsilon, and wherein the second polypeptide has an amino acid sequence of SEQ ID NO: 167 and binds HER2;
   v) the CD3 protein complex and HER2, wherein the first polypeptide has an amino acid sequence of SEQ ID NO: 168 and is assembled with a light chain amino acid sequence of SEQ ID NO: 89 and binds CD3 epsilon, and wherein the second polypeptide has an amino acid sequence of SEQ ID NO: 167 and binds HER2;
   vi) the CD3 protein complex and CD38, wherein the first polypeptide has an amino acid sequence of SEQ ID NO: 169 and is assembled with a cognate light chain amino acid sequence of SEQ ID NO: 119 and binds CD38, and wherein the second polypeptide has an amino acid sequence of SEQ ID NO: 162 and binds CD3 epsilon;
   vii) the CD3 protein complex and CD38, wherein the first polypeptide has an amino acid sequence of SEQ ID NO: 170 and is assembled with a cognate light chain amino acid sequence of SEQ ID NO: 138 and binds CD38, and wherein the second polypeptide has an amino acid sequence of SEQ ID NO: 171 and binds CD3 epsilon;
   viii) the CD3 protein complex and CD38, wherein the first polypeptide has an amino acid sequence of SEQ ID NO: 176 and is assembled with a cognate light chain amino acid sequence of SEQ ID NO: 119 and binds CD38, and wherein the second polypeptide has an amino acid sequence of SEQ ID NO: 177 and binds CD3 epsilon;
   ix) the CD3 protein complex and CD38, wherein the first polypeptide has an amino acid sequence of SEQ ID NO: 178 and is assembled with a cognate light chain amino acid sequence of SEQ ID NO: 128 and binds CD38, and wherein the second polypeptide has an amino acid sequence of SEQ ID NO: 179 and binds CD3 epsilon;
x) the CD3 protein complex and OX40 wherein the first polypeptide has an amino acid sequence of SEQ ID NO: 172 and is assembled with a cognate light chain amino acid sequence of SEQ ID NO: 173 and binds OX40, and wherein the second polypeptide has an amino acid sequence of SEQ ID NO: 162 and binds CD3 epsilon;
xi) the CD3 protein complex and EGFR wherein the first polypeptide has an amino acid sequence of SEQ ID NO: 174 and is assembled with a cognate light chain amino acid sequence of SEQ ID NO: 175 and binds EGFR, and wherein the second polypeptide has an amino acid sequence of SEQ ID NO: 171 and binds CD3 epsilon; or
xii) the CD3 protein complex and CD20; wherein the first polypeptide has an amino acid sequence of SEQ ID NO: 180 and is assembled with a cognate light chain amino acid sequence of SEQ ID NO: 181 and binds CD20, and wherein the second polypeptide has an amino acid sequence of SEQ ID NO 177 and binds CD3 epsilon.

2. An in vitro method for the production of a hetero-dimeric immunoglobulin or fragment thereof of claim 1 comprising the following steps:
ia) preparing a DNA vector encoding a heavy chain of the first polypeptide and a DNA vector encoding a heavy chain of the second polypeptide wherein one or both DNA vectors or a third DNA vector optionally encode a common light chain or a light chain that assembles with a heavy chain of the first or second polypeptide; or
ib) preparing one DNA vector encoding heavy chains of the first and second polypeptides wherein the DNA vector optionally encodes a common light chain or a light chain that assembles with a heavy chain of the first or second polypeptide; and
wherein said DNA vectors are suitable for transient or stable expression in a mammalian host cell;
ii) transfecting or co-transfecting the DNA vector(s) from (ia) or (ib) in a mammalian host cell line;
iii) culturing the transfected cell line or stably selected clone therefrom and harvesting the cell culture supernatant;
iv) contacting the cell culture supernatant on a Protein A affinity chromatography resin; and
v) eluting and collecting the hetero-dimeric immunoglobulin of interest.

3. A method according to claim 2, wherein the hetero-dimeric immunoglobulin or fragment thereof found in the purified material from step (v) is at least 95% pure as determined by capillary electrophoresis.

* * * * *